United States Patent 7,745,391 (HUMAN THROMBOSPONDIN POLYPEPTIDE) - sequence listing, part 266

SEQ ID NO: 758423 - protein, 122 aa, Homo sapiens
SCANHHQYQLCELGCLWGKRLQYSILGVWAANLACSGFPPCALGWAQPQEGTPDTAPTSRLKADALPAPPVFCVAALTHVCLSRPVPRRLSDPKKGFPDTRTEAGGLGLREGGGPAGTFLLC

SEQ ID NO: 758424 - protein, 108 aa, Homo sapiens
ERLIWQGMLSQEKMPAGGRCPGLWLFPAPFTLSGPVTGWGPASRSLYAHQSPRCGVGTWRAPCCMERSCHQQMPQWLCGNTRLTPPKDQQPGTSPSSPRFCFQEALRA

SEQ ID NO: 758425 - protein, 101 aa, Homo sapiens
YLFITQECHYYTRNPHQISRKTTLRTIRPSCLWPISLSTASCAFQQSNSMNDLPVGKMGTSQCADPKICLPKANHHCILRSFKCRCLFEYIKNNIKVIIYV

SEQ ID NO: 758426 - protein, 109 aa, Homo sapiens
LAGLPGWPDPPPSGQRTSAAWKRPCHGALRPREGSRGPQKHHRARLPEPAPAQTRGRPEAVAGQAPGQRFRLPRLQPSVSCGSAAPGGNKWRISGLRAMQPPSEAPKAR

SEQ ID NO: 758427 - protein, 925 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758428 - protein, 127 aa, Homo sapiens
MSLLSSIRVGSSFIEQHIFKFFSCVLFFSYVSLCDNEKTGCKARELKSVYVDAVGQFLKLIFHQNHVNKYNIYNQVALVAINIIGDPADFSDESNTASREKLIDHYLGHNSEDPALEGTYARKESCS

SEQ ID NO: 758429 - protein, 925 aa, Homo sapiens; identical to SEQ ID NO: 758427

SEQ ID NO: 758430 - protein, 893 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGEGQRR

SEQ ID NO: 758431 - protein, 866 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEVRGLGRRDQ

SEQ ID NO: 758432 - protein, 720 aa, Homo sapiens [sequence omitted]

SEQ ID NO: 758433 - protein, 867 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758434 - protein, 859 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758435 - protein, 858 aa, Homo sapiens
MSLLSSIRVGSSFIEQHIFKFFSCVLFFSYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758436 - protein, 526 aa, Homo sapiens [sequence omitted]

SEQ ID NO: 758437 - protein, 463 aa, Homo sapiens [sequence omitted]

SEQ ID NO: 758438 - protein, 492 aa, Homo sapiens
RGTILLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758439 - protein, 409 aa, Homo sapiens
RARYPFAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 758440 - protein, 371 aa, Homo sapiens [sequence omitted]

SEQ ID NO: 758441 - protein, 147 aa, Homo sapiens [sequence omitted]

SEQ ID NO: 758442 - protein, 147 aa, Homo sapiens [sequence omitted]

SEQ ID NO: 758443 - protein, 158 aa, Homo sapiens [sequence omitted]

SEQ ID NO: 758444 - protein, 683 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRVS

SEQ ID NO: 758445 - protein, 327 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELHSAVDPLLPATDPHPKINAPALQPGEGQRR

SEQ ID NO: 758446 - protein, 68 aa, Homo sapiens
LTECDKKDGFGKCYRCSEAVFKEELPRHIKHKDCNRECPFPGSRALGSPGVLLEEVPLLLSLCKGLVN

SEQ ID NO: 758447 - protein, 699 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758448 - protein, 175 aa, Homo sapiens
MTSFLPDSGTADRRQIRAQQGLQSISIGRGTRKRDEDSGTEVGEGTDEWAQSKATVRPPDQLELTDAELKEEFTRILTANNPHAPQNIVRYSFKKQWSLGFIPKLKRKIPVNYWGQDEGEISNETVRVIYSLGIFIMKIVTILLNINIEHLLCVRHCVNRLFLLFLILIIIMQIR

SEQ ID NO: 758449 - protein, 731 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKEGPVPGSAWGPPLGYGTVSPLCHGLSTLHLCRTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758450 - protein, 649 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKSTRTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758451 - protein, 638 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKEKKGQEVQKGPAVEIAKLDKLLNLVREVKIKT

SEQ ID NO: 758452 - protein, 739 aa, Homo sapiens
MDEDSGTEVGEGTDEWAQSKATVRPPDQLELTDAELKEEFTRILTANNPHAPQNIVRYSFKKQWSLGFIPKLKRKIPVNYWGQDEDENFRLTEDLEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKEGPVPGSAWGPPLGYGTVSPLCHGLSTLHLCRTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758453 - protein, 738 aa, Homo sapiens
MTSFLPDSGTADRRQIRAQQGLQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKWGPVPGSAWGPPLGYGTVSPLCHGLSTLHLCRTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758454 - protein, 569 aa, Homo sapiens
MRKLTSMESQTDDLIKLSQAAKIMERMVNQNTYDDIAQDFKYYDDAADEYRDQVGTLLPLWKFQNDKAKRLSVTALCWYSIGIAANAEPLSALYIPNPQYPLLHLTTLSMTCDSIEKYGNLDSYGITRPPPGLPSGEGLSWRTDVCSIFRHQCQWEGPCPQEGHVHFLCQWIHIFFCRNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKEGPVPGSAWGPPLGYGTVSPLCHGLSTLHLCRTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 758455 - protein, 374 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRACYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 758456 - protein, 374 aa, Homo sapiens; identical to SEQ ID NO: 758455

SEQ ID NO: 758457 - protein, 205 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRACYERRREFHLLDSAVYYLSHLERITEEGYVPTAQDVLRSRMPTTGINEYCFSVQKTNLR

SEQ ID NO: 758458 - protein, 189 aa, Homo sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 758459 - protein, 120 aa, Homo sapiens
MPIIPSLWEAGRSLEARSSKIFCILIVVVVTQLYKFVKIQRTIHLKGRLLLYEVYLINNQPKNLCSHFSFPTTYIKKERLWLGPVAHTYNPSTLGGRGGWITRGQEFKTSLANMVEPCLY

SEQ ID NO: 758460 - protein, 63 aa, Homo sapiens
WRVRGRTRTQSRGSLLPKPKPTTTLSAHPTLLEQRAQGSGQRELAPDAKPGLNVWPGLSKDQA

SEQ ID NO: 758461 - protein, 144 aa, Homo sapiens
MCHHKRHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEERVRSIQADGLVWGSSKLVPVGYGIKKLQ

SEQ ID NO: 758462 - protein, 160 aa, Homo sapiens
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAGAAGSPRKTEEATERTTSIATTTTTTTESVEEVVRE

SEQ ID NO: 758463 - protein, 142 aa, Homo sapiens
MGFGDLIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAGAAGSPRKTEEATERTTSIATTTTTTTESVEEVVRE

SEQ ID NO: 758464 - protein, 188 aa, Homo sapiens
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEERVRSIQADGLVWGSSKLVPVGYGIKKLQ

SEQ ID NO: 758465 - protein, 170 aa, Homo sapiens
MPILGIYFQTQRKVHGQFVGHLIQGPQFVRGEVGMQSTLTFNLRSGAVEGNASVSIEGIFRSLRVLFPLFSVGRPQFARSLSAAPQLSDTADTMGFGDLKSPAGLQVLNDYLADKSYIEGYVPSQADVAVFEAVSSPPPADLCHALRWYNHIKSYEKEKASLPGVKKALM

SEQ ID NO: 758466 - protein, 342 aa, Homo sapiens
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRW

SEQ ID NO: 758467 - protein, 498 aa, Homo sapiens
RAPRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758468 - protein, 498 aa, Homo sapiens; identical to SEQ ID NO: 758467

SEQ ID NO: 758469 - protein, 662 aa, Homo sapiens
MKPLEKFLKKQTSQLAGRTVAGGPGGGLGSCGGPGGGGGPGGGGGPAGGQRSLQRRQSVSRLLLPAFLREPPAEPGLEPPLRRKEESRRGSRRSRAAGGPAGCSWRRCRGPGLSGDGGPMRSPSSYSSDELSPGEPLTSPPWAPLGAPERPEHLLNRVLERLAGGATRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758470 - protein, 575 aa, Homo sapiens
RAPRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKGERVTPKLCRFHPCFPSPMPCFYFQLPLDSALSTHLERSPPPQTEWVLGKSGVLGCSGPFRTPLLSFPHIGFSPHPLDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758471 - protein, 392 aa, Homo sapiens
MPSCVHARIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758472 - protein, 847 aa, Homo sapiens
MKPLEKFLKKQTSQLAGRTVAGGPGGGLGSCGGPGGGGGPGGGGGPAGGQRSLQRRQSVSRLLLPAFLREPPAEPGLEPPLRRKEESRRGSRRSRAAGGPAGCSWRRCRGPGLSGDGGPMRSPSSYSSDELSPGEPLTSPPWAPLGAPERPEHLLNRVLERLAGGATRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHEVGTEAGAMLGGWREKCAIGRRCSQHNVLVPRLTVQQALGQRMAVTFVPPSEKNRKERDPRAQWLRAQVLFTQNLTQDFYVLKYSLLKKYNKAETIMPEQMVVLRMSAVSECLAPSKCSVAGEILLMLVVFFFRIFAASCPFYFSIFHPFRPRPPAFRSSSPCTAIFPPTPLTPWRPGRPPLPWVQLEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758473 - protein, 341 aa, Homo sapiens
MPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 758474 - protein, 177 aa, Homo sapiens
DLNFQYAGDVPCVCDVPVFSASGDKNQYLDMTNVMFCETPWLLNTTDPLRNQVAAQWPQANGSLGRLYAMGVDAYRLAPRLGQLKALPDTRVDGLSGNLGIGAYQRVDRQILGHLALKHFARCLNQHLTSFPWSNFLLHGKEVDGFTPGPISLFILLKSPPHCSFKPKLHFAGSCPL

SEQ ID NO: 758475 - protein, 90 aa, Homo sapiens
SLASHLSSQFLRSACVGIFLNLRVSFVRAGGMEGPEGLGRKQACLAMLLHFLDTYQGLLQEEEGAGHIIKVGLGEEKVGKQAISSGRGPL

SEQ ID NO: 758476 - protein, 222 aa, Homo sapiens
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 758477 - protein, 279 aa, Homo sapiens [sequence omitted]

SEQ ID NO: 758478 - protein, 159 aa, Homo sapiens
MHLPEWGSLGALILGSQAHCQGQQDGRHTRISPAFPLCTGRVPGRYLTTRHTCTHTLTLGQNADHSPSLQAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 758479 - protein, 1043 aa, Homo sapiens
MALAALMFWGVCLGPLLVCHRHPVLAPEEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 758480 - protein, 316 aa, Homo sapiens
MLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKVQAAGEGWAGL

SEQ ID NO: 758481 - protein, 125 aa, Homo sapiens
MTVSEMCGRPVASASLSKSSFSSRKRGRAQQPQHLRMQPWVPATISRTCHLPSLSRPGPGGSARGPPGIPARAAECPERTGKPGCAWLDGEPGGPWGGCRVSEQGSVFVPPCRGYRTNFGPRPVP

SEQ ID NO: 758482 - protein, 1313 aa, Homo sapiens
MLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVSTLKGQLQQELRRSSAPFSPPSGPPEK

SEQ ID NO: 758483 - protein, 918 aa, Homo sapiens
MALAALMFWGVCLGPLLVCHRHPVLAPEEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 758484 - protein, 63 aa, Homo sapiens
MPPGPAHPPSPLSPASAQALSLKESEKTALSEKLMGTRHSLATISLEMERQKRDAQSRQEQDR

SEQ ID NO: 758485 - protein, 334 aa, Homo sapiens
MGEAGAAEEACRHMGTKEEFVKVRKKDLERLTTEVMQIRDFLPRILNGEVLESFQKLKIVEKNLERKEQELEQLKMDCEHFKARLETVQADNIREKKEKLALRQQLNEAKQQLLQQAEYCTEMGAAACTLLWGVSSSEEVVKAILGGDKALKFFSITGQTMESFVKSLDGDVQELDSDESQFVFALAGIVTNVAAIACGREFLVNSSRVLLDTILQLLGDLKPGQCTKLKVLMLMSLYNVSINLKGLKYISESPGFIPLLWWLLSDPDAEVCLHVLRLVQSVVLEPEVFSKSASEFRSSLPLQRILAMSKSRNPRLQTAAQELLEDLRTLEHNV

SEQ ID NO: 758486 - protein, 819 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPALQTSEMSSSWNEFRREKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 758487 - protein, 867 aa, Homo sapiens [sequence omitted]

SEQ ID NO: 758488 - protein, 845 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNELLARVREG

SEQ ID NO: 758489 - protein, 837 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNE

SEQ ID NO: 758490 - protein, 984 aa, Homo sapiens [sequence omitted]

SEQ ID NO: 758491 - protein, 415 aa, Homo sapiens
MDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 758492 - protein, 648 aa, Homo sapiens [sequence omitted]

SEQ ID NO: 758493 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 758494 - protein, 196 aa, Homo sapiens
NSALGVREDPAGRPRPACELGRGRGWSLLGATAMDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 758495 - protein, 163 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 758496 - protein, 106 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLHHLFRLQAP

SEQ ID NO: 758497 - protein, 117 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLHPIGSAHDDRTHLGKTDSVM

SEQ ID NO: 758498 - protein, 104 aa, Homo sapiens
TRRGRVGSLTIVLLPTSSRHLSQELLSQTPLERALCQALHLGGPSPAYLLVCKCGLTRRHHPLFQQALHESLCTCTSFSHGPQFQYFSLSGVPDVYLGCYSSPV

SEQ ID NO: 758499 - protein, 122 aa, Homo sapiens
IVFERVYGAGFPGESLCFQFLIKRDMNEKSIWAPTNPPECCGRGWSLLGATAMDALEGESFALSFSSASDAEFDAVVGYLEDIIMDDEFQLLQRNFMDKYYLEFEDTEENKLIYTPIFNEYL

SEQ ID NO: 758500 - protein, 163 aa, Homo sapiens; identical to SEQ ID NO: 758495

SEQ ID NO: 758501 - protein, 163 aa, Homo sapiens; identical to SEQ ID NO: 758495

SEQ ID NO: 758502 - protein, 196 aa, Homo sapiens; identical to SEQ ID NO: 758494

SEQ ID NO: 758503 - protein, 143 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAPEQSAALGPTSSQ

SEQ ID NO: 758504 - protein, 163 aa, Homo sapiens; identical to SEQ ID NO: 758495

SEQ ID NO: 758505 - protein, 163 aa, Homo sapiens; identical to SEQ ID NO: 758495

SEQ ID NO: 758506 - protein, 103 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPELTQGRAANSGAELLIQ

SEQ ID NO: 758507 - protein, 434 aa, Homo sapiens
GLRHKTARGSQGRQRRTMRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFMDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLAKVAKIGTDVLSTRYETRYIYGPIESTIYPISGSSLDWAYDLGIKHTFAFELRDKGKFGFLLPESRIKPTCRETMLAVKFIAKYILKHTS

SEQ ID NO: 758508 - protein, 353 aa, Homo sapiens
GLRHKTARGSQGRQRRTMRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFMDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLSKFQIGLWS

SEQ ID NO: 758509 - protein, 434 aa, Homo sapiens; identical to SEQ ID NO: 758507

SEQ ID NO: 758510 - protein, 68 aa, Homo sapiens
YCLCFTDPISGSSLDWAYDLGIKHTFAFELRDKGKFGFLLPESRIKPTCRETMLAVKFIAKYILKHTS

SEQ ID NO: 758511 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 758512 - protein, 483 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLVS

SEQ ID NO: 758513 - protein, 598 aa, Homo sapiens
MLEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 758514 - protein, 195 aa, Homo sapiens
PQAPPALPSPPDPGAMWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQGMHPHRWPEAP

SEQ ID NO: 758515 - protein, 292 aa, Homo sapiens
PQAPPALPSPPDPGAMWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 758516 - protein, 292 aa, Homo sapiens; identical to SEQ ID NO: 758515

SEQ ID NO: 758517 - protein, 292 aa, Homo sapiens; identical to SEQ ID NO: 758515

SEQ ID NO: 758518 - protein, 81 aa, Homo sapiens
MRSDGPGDRVEKGQGLGGRLPWRKEGPTEAGPCLAAGTGQEQRWGLQSPADWGHTCCPDPAQDRCHPVLMTTSALLRAPAT

SEQ ID NO: 758519 - protein, 37 aa, Homo sapiens [sequence omitted]

SEQ ID NO: 758520 - protein, 422 aa, Homo sapiens
MDGMLLNGLNVFVGRFRSPKEQEAELGARAKESKVGPASSVKVITDEGGKSKGFGFVSFERHEDPQTAMDVNGKEFSGNQTYICLAPKKVEEQTELKCKFEQMKQDRITRYQGANVCVKNLDESIDDERLQKEFSPFGIINSANVMMEGGCSKRFGFVCFSSPEEVAKAVTAMNGKIVASKPLHVALAQCKEQRLAHFTNQYMQKMASVRAVPHPVINPYQPAPSTCYFVAAIPQTQNRAAYYPPGQIAQLRPSPPWAVQSVRPYPFQISPVLSAQLLVTTTLRPASSQVPPVMSTQYVANSSIQTISPCPVAAAAGSTPAVYIIPQYKYASGILIPQQHLKAHPQVTRKQLAVHVQGQKLLTASMLASAPLQQQKQILGERLFPLIQATHPTLAGKITGMLLELDNLKLLHMLVSPESLKL

SEQ ID NO: 758521 - protein, 255 aa, Homo sapiens
MHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 758522 - protein, 288 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 758523 - protein, 288 aa, Homo sapiens; identical to SEQ ID NO: 758522

SEQ ID NO: 758524 - protein, 288 aa, Homo sapiens; identical to SEQ ID NO: 758522

SEQ ID NO: 758525 - protein, 288 aa, Homo sapiens; identical to SEQ ID NO: 758522

SEQ ID NO: 758526 - protein, 288 aa, Homo sapiens; identical to SEQ ID NO: 758522

SEQ ID NO: 758527 - protein, 288 aa, Homo sapiens; identical to SEQ ID NO: 758522

SEQ ID NO: 758528 - protein, 249 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGTKTKNQDESRKLTQKSMY

SEQ ID NO: 758529 - protein, 280 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHGRTALYQFLFYLPNSKLVFLLICTIPLKM

SEQ ID NO: 758530 - protein, 240 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGTFYLSPGEG

SEQ ID NO: 758531 - protein, 105 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKISNVIFFNESNT

SEQ ID NO: 758532 - protein, 159 aa, Homo sapiens
RGAPATLHAGGTRRLMKELQDIARLSSRFISVELVDESLFDWNVKLHQVDKDSVLWQDMKETNTEFILLNLTFPDNFPFSPPFMRVLSPRLENGYVLDGGASAWSCSRRAAGPAPTPWRPSCASSQPAWSRARDGSVEKLANQKSPSVARKLKLPLRVW

SEQ ID NO: 758533 - protein, 98 aa, Homo sapiens
YLSLITGNEDISHLQIAHPIRKLGQRSLSLQKRSSSNPLGKVSKVWESRCEVKQCGRGANSANAGHGQLATSSLPEEGLSKLHTNPGSLSPNIVLCHL

SEQ ID NO: 758534 - protein, 128 aa, Homo sapiens
ERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKCEYN

SEQ ID NO: 758535 - protein, 137 aa, Homo sapiens
ERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKCPMSLPLKFGQNL

SEQ ID NO: 758536 - protein, 166 aa, Homo sapiens
ERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKSNLDARKLLKLNLLLHLKRSITSITPPKNLPKIKHAVVSPGA

SEQ ID NO: 758537 - protein, 162 aa, Homo sapiens
GGAWWAGCAVVGDGGASAPRPSWAAGHPRWPDANSDIDLSNLERLEKYRSFDRYRRRAEQEARPRTGGGPTESISGRRQIPKRRLILGCLHPKSPGPNSYWNGNRPSRSFGPMWKRSGLPASAQPVFPLDAVRAEWERTFGPYHKQLLLSIYGFNEFSTVNF

SEQ ID NO: 758538 - protein, 254 aa, Homo sapiens
VSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 758539 - protein, 254 aa, Homo sapiens; identical to SEQ ID NO: 758538

SEQ ID NO: 758540 - protein, 335 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 758541 - protein, 335 aa, Homo sapiens; identical to SEQ ID NO: 758540

SEQ ID NO: 758542 - protein, 335 aa, Homo sapiens; identical to SEQ ID NO: 758540

SEQ ID NO: 758543 - protein, 335 aa, Homo sapiens; identical to SEQ ID NO: 758540

SEQ ID NO: 758544 - protein, 105 aa, Homo sapiens
PGAISAHCDLCLRVVGLQLCTTQSAPRPPCQACARISVTLQMRKLSLWEADKVPDTGQGRAHPHGLCCSLCLVGHGTPSTRSPSRMRRRVPGALGMSLAEKAAQG

SEQ ID NO: 758545 - protein, 42 aa, Homo sapiens
FYPRGQHGAVEQCEPVKDLAVRTTFLGTPFPVLLAHFPSPIP

SEQ ID NO: 758546 - protein, 124 aa, Homo sapiens
RAAGIRHEDWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758547 - protein, 78 aa, Homo sapiens
METGETCISANPLNVPRKHWWTDSSAEKKHVWFGESMDGGFQFSYGNPELPEDVLDVQLAFLRLLSSRASRQNGVPTL

SEQ ID NO: 758548 - protein, 75 aa, Homo sapiens
MLSHFRVKVKGFILISKYFDPYDLVSSYPKYGPHTSRTGILWELVRNVESLVLRFSKSESAFSSALLAIHMFEKD

SEQ ID NO: 758549 - protein, 105 aa, Homo sapiens
ITLEPFGGKGDAGAPGERGPPGLAGAPGLRGGAGPPGPEGGKVLLVLQEKMENLGNQVQRVMPVLELQEARVMLVPLVNVDLLDWQGPQLEVELVPGPERLQGFG

SEQ ID NO: 758550 - protein, 1429 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758551 - protein, 1381 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758552 - protein, 861 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPLLVPLVLAVVVLEPLPLLGLEVKKLAVLPRIMEMNQWISKSTPMRL

SEQ ID NO: 758553 - protein, 134 aa, Homo sapiens
METGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758554 - protein, 1346 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQVGKDIPFFK

SEQ ID NO: 758555 - protein, 1429 aa, Homo sapiens; identical to SEQ ID NO: 758550

SEQ ID NO: 758556 - protein, 1429 aa, Homo sapiens; identical to SEQ ID NO: 758550

SEQ ID NO: 758557 - protein, 121 aa, Homo sapiens
MNREHVVAANECSEEDTFGLGESMEWWSQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758558 - protein, 109 aa, Homo sapiens
ELGTLRIPHYVMDGAFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758559 - protein, 1428 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTGRKHFSQYRS

SEQ ID NO: 758560 - protein, 1429 aa, Homo sapiens; identical to SEQ ID NO: 758550

SEQ ID NO: 758561 - protein, 1429 aa, Homo sapiens; identical to SEQ ID NO: 758550

SEQ ID NO: 758562 - protein, 1428 aa, Homo sapiens; identical to SEQ ID NO: 758559

SEQ ID NO: 758563 - protein, 1429 aa, Homo sapiens; identical to SEQ ID NO: 758550

SEQ ID NO: 758564 - protein, 1429 aa, Homo sapiens; identical to SEQ ID NO: 758550

SEQ ID NO: 758565 - protein, 1429 aa, Homo sapiens; identical to SEQ ID NO: 758550

SEQ ID NO: 758566 - protein, 1470 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHWWTDSSAEKKHVWFGESMDGGFQFSYGNPELPEDVLDVQLAFLRLLSSRA

SEQ ID NO: 758567 - protein, 1427 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEETHWGNGAKQSLNIEPRKGCETTYCRYCTL

SEQ ID NO: 758568 - protein, 1365 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRAS

SEQ ID NO: 758569 - protein, 1342 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQVSLAE

SEQ ID NO: 758570 - protein, 1192 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGRGILKRPRTN

SEQ ID NO: 758571 - protein, 1204 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGLLSAGCNRSSRNCGPEDLLAQWTPGKDGPVGSLLGPRVLSDRGETVGGPRALAQASCLCAWSVVFGRCGGGTRFRLGLLNRF

SEQ ID NO: 758572 - protein, 1096 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPPGSEVLVVVRPRGDKVNR

SEQ ID NO: 758573 - protein, 891 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNVSNC

SEQ ID NO: 758574 - protein, 905 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKSQRWFRLQLPAPATSREGSRGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYINKNPKDKRHVWFGESMTDGIPFQFGGQGFDPSDVAIQLT

SEQ ID NO: 758575 - protein, 77 aa, Homo sapiens
METGETCISANPLNVPRKHWWTDSSAEKKHVWFGESMDGGFQFSYGNPELPEDVLDVQLAFLRLLSSRASPPLNPPG

SEQ ID NO: 758576 - protein, 116 aa, Homo sapiens
VIRVRRYSTEKNTEVEESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758577 - protein, 1396 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758578 - protein, 938 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758579 - protein, 1429 aa, Homo sapiens; identical to SEQ ID NO: 758550

SEQ ID NO: 758580 - protein, 1429 aa, Homo sapiens; identical to SEQ ID NO: 758550

SEQ ID NO: 758581 - protein, 1429 aa, Homo sapiens; identical to SEQ ID NO: 758550

SEQ ID NO: 758582 - protein, 104 aa, Homo sapiens
GTEAHSMDGGFQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758583 - protein, 102 aa, Homo sapiens
DTARPGRGSQFSYGNPELPEDVLDVQLAFLRLLSSRASQNITYHCKNSIAYMDQASGNVKKALKLMGSNEGEFKAEGNSKFTYTVLEDGCTKHTGEMEQNSL

SEQ ID NO: 758584 - protein, 1429 aa, Homo sapiens; identical to SEQ ID NO: 758550

SEQ ID NO: 758585 - protein, 1399 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMENTLGKWSKTVFEYRTTQGL

SEQ ID NO: 758586 - protein, 1429 aa, Homo sapiens; identical to SEQ ID NO: 758550

SEQ ID NO: 758587 - protein, 1429 aa, Homo sapiens; identical to SEQ ID NO: 758550

SEQ ID NO: 758588 - protein, 1429 aa, Homo sapiens; identical to SEQ ID NO: 758550

SEQ ID NO: 758589 - protein, 1429 aa, Homo sapiens; identical to SEQ ID NO: 758550

SEQ ID NO: 758590 - protein, 1429 aa, Homo sapiens; identical to SEQ ID NO: 758550

SEQ ID NO: 758591 - protein, 1428 aa, Homo sapiens; identical to SEQ ID NO: 758559

SEQ ID NO: 758592 - protein, 1436 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTVIFCTIGDLLHDEVIICT

SEQ ID NO: 758593 - protein, 1373 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASRQNGVPTL

SEQ ID NO: 758594 - protein, 1328 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKPPAEGDEKKSESYSY

SEQ ID NO: 758595 - protein, 1170 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRVSSTERYYRSTCFRCLHFRKIFWHCDVMILS

SEQ ID NO: 758596 - protein, 878 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPVSIDPLNYY

SEQ ID NO: 758597 - protein, 866 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGVHYFS

SEQ ID NO: 758598 - protein, 761 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPR

SEQ ID NO: 758599 - protein, 112 aa, Homo sapiens
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIANDDCELCVNVACTGCL

SEQ ID NO: 758600 - protein, 396 aa, Homo sapiens
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 758601 - protein, 273 aa, Homo sapiens [sequence omitted]

SEQ ID NO: 758602 - protein, 399 aa, Homo sapiens
MQSLSTEARYVPRVPQHRDQISPRSPQHGGQICPRSPLHRGQICPRSPPARRYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 758603 - protein, 273 aa, Homo sapiens [sequence omitted]

SEQ ID NO: 758604 - protein, 373 aa, Homo sapiens
MLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 758605 - protein, 273 aa, Homo sapiens [sequence omitted]

SEQ ID NO: 758606 - protein, 185 aa, Homo sapiens
QWSITKMGNAAMGPAEMDIRPWCLRALQLRCYQQSLSRQQYNAEQYSTSQGRCEPMGQQYYTGGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 758607 - protein, 361 aa, Homo sapiens
VPRSGLEPNISNGQGWGAHRAGAAGVSGGEDAECQLEGQNTLHHHGLALRCVVGRARCLPCTEDRGCGDSLGAWIYCLLRERPTQTQPCMLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 758608 - protein, 342 aa, Homo sapiens
NQFLQTARTVTFIIQKNKNQIIGYDIWYNNNVIEKWKNDPLMAWAKNSGDSLGAWIYCLLRERPTQTQPCMLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 758609 - protein, 361 aa, Homo sapiens; identical to SEQ ID NO: 758607

SEQ ID NO: 758610 - protein, 255 aa, Homo sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 758611 - protein, 255 aa, Homo sapiens; identical to SEQ ID NO: 758610

SEQ ID NO: 758612 - protein, 340 aa, Homo sapiens
VPRSGLEPNISNGQGWGAHRAGAAGVSGGEDAECQLEGQNTLHHHGLALRCVVGRARCLPCTEDRGCGDSLGAWIYCLLRERPTQTQPCMLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSAALCEGLWSHSYKVSNYSRGSGRCIQMWFDSAQGNPNEEVARFYAAAMHVNAGEMLHGTGGLLLSLALMLQLWLLG

SEQ ID NO: 758613 - protein, 170 aa, Homo sapiens
MEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 758614 - protein, 832 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 758615 - protein, 384 aa, Homo sapiens
LSAFCIQLFIAELVGPCRKDGDRWIQCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 758616 - protein, 832 aa, Homo sapiens; identical to SEQ ID NO: 758614

SEQ ID NO: 758617 - protein, 609 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLHPLGAPLLTPHLPPSIIPTPHWRPGQGRTPRTLLLLIHFPHCVFSWTEHPLEMGAGI

SEQ ID NO: 758618 - protein, 832 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKEMSRREGSILLSKAPSESAALDGHRLALLDSGYDILAAVLLELLSL

SEQ ID NO: 758619 - protein, 79 aa, Homo sapiens
LELALLSLSSPFCHHHLINIVDFPPLLASSFDSLWKKCQEEKVRSYSARPHLNQLRWMDTALHCWILGMTYSQQCYWNY

SEQ ID NO: 758620 - protein, 605 aa, Homo sapiens
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 758621 - protein, 113 aa, Homo sapiens
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 758622 - protein, 633 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILSELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 758623 - protein, 695 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 758624 - protein, 248 aa, Homo sapiens
WSLSASVSGCPRPPRNLTTMFRPALGSQQVVRNMTSEFFAAQLRSQISDHTTHPISYYKPEFYTPDDGGTAHLSVVAEDGSAVSATSTINLYGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 758625 - protein, 326 aa, Homo sapiens
LNNYRAELIEHPLNISLGDAVLYMPSARLSGPVLALILNILKGYNFSRESVETPEQKGLTYHRIVEAFRFAYAKRTLLGDPKFVDVTDVRPALGSQQVVRNMTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 758626 - protein, 275 aa, Homo sapiens
SCFRLGSSSCGNPGSLRPASPERSEPTRPALPKPRVLRPGVPAPRSPSTRESRASRPGVPEPAPPHPDTPRPRDCPRATASGSWSSWGAITIPRNGPWLHSGTHPGAWGSFWTTRLDISLSTVPPMGHCYSSFPRSPSRGRCGPLLTPVQQPDPDDYLPAERWVRGHPGSPVTRALLEESCCLSCPSRPLSVLATWRTWEEGVCPLSKRRNSWCLSEPAWENPNSSTPGNCGRVWGRLRPPWETPPATGCHLMPTALTKAGSPIAPAALACGSRS

SEQ ID NO: 758627 - protein, 546 aa, Homo sapiens
FLFPPRLLFLRESGIPTSRVPRALGAYAPSATETQSPAPWSPRAPEPEHPGVPSLAPRSARACAAAPGYPASPRAAEAARRRPADSTAFLPSVRAMAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPSSHPCPAARPR

SEQ ID NO: 758628 - protein, 250 aa, Homo sapiens
FLFPPRLLFLRESGIPTSRVPRALGAYAPSATETQSPAPWSPRAPEPEHPGVPSLAPRSARACAAAPGYPASPRAAEAARRRPADSTAFLPSVRAMAAPDLSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPSSHPCPAARPR

SEQ ID NO: 758629 - protein, 150 aa, Homo sapiens
MGHCYSSFPRSPSRGRCGPLLTPVQQPDPDDYLPAERWVRGHPGSPVTRALLEESCCLSCPSRPLSVLATWRTWEEGVCPLSKRRNSWCLSEPAWENPNSSTPGNCGRVWGRLRPPWETPPATGCHLMPTALTKAGSPIAPAALACGSRS

SEQ ID NO: 758630 - protein, 403 aa, Homo sapiens
FLFPPRLLFLRESGIPTSRVPRALGAYAPSATETQSPAPWSPRAPEPEHPGVPSLAPRSARACAAAPGYPASPRAAEAARRRPADSTAFLPSVRAMAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKDIKDALRRYEPSLSWRGGRREWGGTQLLAMADNTWVVPSRVQDVKLQPPEVVPMELRTVCRVPGLVETLRRFRGRCGGPRWGDDSRRGPAKDLGSQPRVLCPATASSKLTVSWWWVVGKTSSAHASDISCVGIFTPNNSSTSGNELGIQGFHSALNRIASADTTGVSTDPTD

SEQ ID NO: 758631 - protein, 236 aa, Homo sapiens
ARGETLACKLAELIAELEGRCQLPALGLLQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPSSHPCPAARPR

SEQ ID NO: 758632 - protein, 467 aa, Homo sapiens
FLFPPRLLFLRESGIPTSRVPRALGAYAPSATETQSPAPWSPRAPEPEHPGVPSLAPRSARACAAAPGYPASPRAAEAARRRPADSTAFLPSVRAMAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQLGCPSRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPSSHPCPAARPR

SEQ ID NO: 758633 - protein, 275 aa, Homo sapiens; identical to SEQ ID NO: 758626

SEQ ID NO: 758634 - protein, 480 aa, Homo sapiens
FLFPPRLLFLRESGIPTSRVPRALGAYAPSATETQSPAPWSPRAPEPEHPGVPSLAPRSARACAAAPGYPASPRAAEAARRRPADSTAFLPSVRAMAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGRCGGPRWGDDSRRGPAKDLGSQPRVLCPATASSKLTVSWWWVVGKTSSAHASDISCVGIFTPNNSSTSGNELGIQGFHSALNRIASADTTGVSTDPTD

SEQ ID NO: 758635 - protein, 129 aa, Homo sapiens
LLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 758636 - protein, 108 aa, Homo sapiens
LLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNF

SEQ ID NO: 758637 - protein, 239 aa, Homo sapiens
GEVWRTLRGGGGRGELAMSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 758638 - protein, 227 aa, Homo sapiens
MFSFTKFGPTPLDSSGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 758639 - protein, 221 aa, Homo sapiens
GEVWRTLRGGGGRGELAMSGLGRLFGKGKKEKGPTPEEAIQKLKETEKILIKKQEFLEQKIQQELQTAKKYGTKNKRAALQALRRKFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 758640 - protein, 72 aa, Homo sapiens
MSSARLYTDELLEELEELEQEELAQELLNVGDKEEEPSVKLPSVPSTHLPAGPAPKVDEDEEALKQLAEWVS

SEQ ID NO: 758641 - protein, 239 aa, Homo sapiens; identical to SEQ ID NO: 758637

SEQ ID NO: 758642 - protein, 231 aa, Homo sapiens
GEVWRTLRGGGGRGELAMSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPGMQGCSVVLRT

SEQ ID NO: 758643 - protein, 87 aa, Homo sapiens
GDSVACGGRALSLKKKYITRYTREARGVLVVGVRRTPRGCIGDYMLGARCSALSVGAAAPEGAYANPPASTLAFGCMEASSRLGEKS

SEQ ID NO: 758644 - protein, 66 aa, Homo sapiens
VWAFSGGLLRNVCNCKASLSSRFTQIRKLWRQTTIAEACPDYFTYITKSCKGSVPIGSPPITPHTT

SEQ ID NO: 758645 - protein, 70 aa, Homo sapiens
AHEAALVDWSLMPAALPYWSCMLVVLQCWCLGSGLTPMAPGGIALVRDLCGGSVPVTSFCLGFQAVHDIL

SEQ ID NO: 758646 - protein, 86 aa, Homo sapiens
FHTARALYNQGLTQLQHERDLRATESCSVPRLWIPPVMGSSLLPSPAQAIVTQAQSPTPAPHQHPESSLPSYQAFEQAFPTPASFG

SEQ ID NO: 758647 - protein, 791 aa, Homo sapiens
ETLFLSSPQQQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758648 - protein, 284 aa, Homo sapiens
SLSQKVATSVTALLGFGLEYPGGGQHKLVLHPGLRECLVLPEEGRREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRDQVWGSS

SEQ ID NO: 758649 - protein, 758 aa, Homo sapiens
RDKWAPAERREIRAAAASWLRAAEQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758650 - protein, 308 aa, Homo sapiens
MRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758651 - protein, 805 aa, Homo sapiens
RDKWAPAERREIRAAAASWLRAAEQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758652 - protein, 744 aa, Homo sapiens
TGEVQLRVRYSYGGGTAGCERLRKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758653 - protein, 598 aa, Homo sapiens
RDKWAPAERREIRAAAASWLRAAEQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSISGGDVWAEPPVLLAAVTGPPWGPALSQRDPQSKASRELPDSCLALATALAGVQPVPLSSPLVKFRMGVPSSADRLTPPLGFIPGAESSDLPRSEVPCALSYLGRMQRPSLAAVCGPWGSVTQPGAEEQGSEPGQRTFLRPPVCRPGAWCRGPSGEQDPAVAMGLSSGGESEEDVDEVEKRFQV

SEQ ID NO: 758654 - protein, 454 aa, Homo sapiens
GFPRGRSQTISPWLWPPLCLGLATESCVSVAAFSLPVCVVSRKLHSRARVGRVSRSPCQSTPIPACFDLNLVTFRPSVEWGRMNSLSWLMAATGARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 758655 - protein, 118 aa, Homo sapiens
MAEQEPTAEQLAQIAAENEEDEHSVNYKPPAQKSIQEIQELDKDDESLRKYKEALLGRCGRFRRPQRPQRRGDWPDPGVQLGPGPPGAGPDGRPGELQEAVVCAEGGCGVPDKNLFPG

SEQ ID NO: 758656 - protein, 118 aa, Homo sapiens; identical to SEQ ID NO: 758655

SEQ ID NO: 758657 - protein, 171 aa, Homo sapiens
SQAGPAQVLWICVCMSMWPPRPFPGGEPSDPGTRGVCCCCSPAHQCLASLPPSLDRAVEMAPAAWGKPNCQNSSHLSTIQEAGYCPASAFSVSAGSAQSPHPPKSPRWTASPTPPGPSQEPRLAISIYCLRPCRPWATGLAPVPPGSQCHHPRQAFPDPARNKQGTKCTHC

SEQ ID NO: 758658 - protein, 158 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKIDKTDYMVGSYSIKSRFTDDDKTDHLSWEWNLTIKKDWKD

SEQ ID NO: 758659 - protein, 139 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKIDKTDYMVGRAMGPGPRSTSS

SEQ ID NO: 758660 - protein, 149 aa, Homo sapiens
MAEQEPTAEQLAQIAAENEEDEHSVNYKPPAQKSIQEIQELDKDDESLRKYKEALLGRCGRFRRPQRPQRRGDWPDPGVQLGPGPPGAGPDGVSALRPRGSGRPLVGISGSAARGPRRAGASRRAAGQSLRGRSPQQATWRASRSSRLC

SEQ ID NO: 758661 - protein, 118 aa, Homo sapiens; identical to SEQ ID NO: 758655

SEQ ID NO: 758662 - protein, 118 aa, Homo sapiens; identical to SEQ ID NO: 758655

SEQ ID NO: 758663 - protein, 208 aa, Homo sapiens
MLARGSLQHQVPLHRRRQDRPPVLGVESHHQEGLEGLSPARGGQGRLTDGRRTGGCCPPPQPLPSPYQSADRPSVPLPPWSASLAWLNRVPPTPLLSPPPPTGPASSVSCLVAASACAVGERGRSQASAALSVPPRFYLPVTPEAWLQEGAEQPFSRPRGCPWTCASAAPGWSWGVGCTASWGPGRPPAPLLPGQPPCRCRSRLTMMP

SEQ ID NO: 758664 - protein, 158 aa, Homo sapiens; identical to SEQ ID NO: 758658

SEQ ID NO: 758665 - protein, 118 aa, Homo sapiens; identical to SEQ ID NO: 758655

SEQ ID NO: 758666 - protein, 118 aa, Homo sapiens; identical to SEQ ID NO: 758655

SEQ ID NO: 758667 - protein, 118 aa, Homo sapiens; identical to SEQ ID NO: 758655

SEQ ID NO: 758668 - protein, 118 aa, Homo sapiens; identical to SEQ ID NO: 758655

SEQ ID NO: 758669 - protein, 118 aa, Homo sapiens; identical to SEQ ID NO: 758655

SEQ ID NO: 758670 - protein, 205 aa, Homo sapiens
MAEQEPTAEQLAQIAAENEEDEHSVNYKPPAQKSIQEIQELDKDDESLRKYKEALLGRCGRFRRPQRPQRRGDWPDPGVQLGPGPPGAGPDGVSALRPRGSGRPLVGISGKCSQGAAQGWGFAQGCWAVIEGEVPPTGDLESFKKQSFVLKEGVEYRIKISFRVNREIVSGMKYIQHTYRKGVKIDKTDYMVGRAMGPGPRSTSS

SEQ ID NO: 758671 - protein, 209 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKKLWAPGRGVRVPDPRGGGTQGYAGPGQPTASSPASQTTTRPTTCPGSGISPSRRTGRTEPSQRRAGQTDGRTTDRRMLSPPPAPPLPIPKC

SEQ ID NO: 758672 - protein, 208 aa, Homo sapiens; identical to SEQ ID NO: 758663

SEQ ID NO: 758673 - protein, 118 aa, Homo sapiens; identical to SEQ ID NO: 758655

SEQ ID NO: 758674 - protein, 118 aa, Homo sapiens; identical to SEQ ID NO: 758655

SEQ ID NO: 758675 - protein, 118 aa, Homo sapiens; identical to SEQ ID NO: 758655

SEQ ID NO: 758676 - protein, 118 aa, Homo sapiens; identical to SEQ ID NO: 758655

SEQ ID NO: 758677 - protein, 118 aa, Homo sapiens; identical to SEQ ID NO: 758655

SEQ ID NO: 758678 - protein, 118 aa, Homo sapiens; identical to SEQ ID NO: 758655

SEQ ID NO: 758679 - protein, 118 aa, Homo sapiens; identical to SEQ ID NO: 758655

SEQ ID NO: 758680 - protein, 134 aa, Homo sapiens
MLARGSLQHQVPLHRRRQDRPPVLGVESHHQEGLEGLSPARGGQGRLTDGRRTGGCCPPPPPPPPPPPPPPPPPPPPPPPPPTTRPAPRVPAACARQPAPPPPRRAPSSSPASPLPAVLRPPAPPLAPSPSSRR

SEQ ID NO: 758681 - protein, 118 aa, Homo sapiens; identical to SEQ ID NO: 758655

SEQ ID NO: 758682 - protein, 118 aa, Homo sapiens; identical to SEQ ID NO: 758655

SEQ ID NO: 758683 - protein, 118 aa, Homo sapiens; identical to SEQ ID NO: 758655

SEQ ID NO: 758684 - protein, 118 aa, Homo sapiens; identical to SEQ ID NO: 758655

SEQ ID NO: 758685 - protein, 158 aa, Homo sapiens; identical to SEQ ID NO: 758658

SEQ ID NO: 758686 - protein, 189 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKIDKTDYMVGRAMGPGPRSTSSGRPSLTQPGTNKGPSAHIAESRLLCLPRPIPGLRVVSARLRQRRLSLLLF

SEQ ID NO: 758687 - protein, 164 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKIDKTDYMVGRAMGPGPRSTSSLPRPIPGLRVVSARLRQRRLSLLLF

SEQ ID NO: 758688 - protein, 134 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKKDYYTGSSHGHRNGGR

SEQ ID NO: 758689 - protein, 149 aa, Homo sapiens; identical to SEQ ID NO: 758660

SEQ ID NO: 758690 - protein, 118 aa, Homo sapiens; identical to SEQ ID NO: 758655

SEQ ID NO: 758691 - protein, 122 aa, Homo sapiens
MAEQEPTAEQLAQIAAENEEDEHSVNYKPPAQKSIQEIQELDKDDESLRKYKEALLGRCGRFRRPQRPQRRGDWPDPGVQLGPGPPGAGPDGRPGELQEAVVCAEGGCGVPDKNLFPAVGPH

SEQ ID NO: 758692 - protein, 118 aa, Homo sapiens; identical to SEQ ID NO: 758655

SEQ ID NO: 758693 - protein, 118 aa, Homo sapiens; identical to SEQ ID NO: 758655

SEQ ID NO: 758694 - protein, 118 aa, Homo sapiens; identical to SEQ ID NO: 758655

SEQ ID NO: 758695 - protein, 118 aa, Homo sapiens; identical to SEQ ID NO: 758655

SEQ ID NO: 758696 - protein, 118 aa, Homo sapiens; identical to SEQ ID NO: 758655

SEQ ID NO: 758697 - protein, 202 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQHTYRKGVKIDKTDYMVGRAMGPGPRSTSSWRLFPQALSATTPGRPSLTQPGTNKGPSAHIAESRLLCLPRPIPGLRVVSARLRQRRLSLLLF

SEQ ID NO: 758698 - protein, 202 aa, Homo sapiens; identical to SEQ ID NO: 758697

SEQ ID NO: 758699 - protein, 173 aa, Homo sapiens
MSTRSTTSPRPRRASRRSRSWTRTTRACESTRRPCWAAVAVSADPNVPNVVVTGLTLVCSSAPGPLELDLTGDLESFKKQSFVLKEGVEYRIKISFRVNREIVSGMKYIQWRLFPQALSATTPGRPSLTQPGTNKGPSAHIAESRLLCLPRPIPGLRVVSARLRQRRLSLLLF

SEQ ID NO: 758700 - protein, 155 aa, Homo sapiens [sequence omitted]

SEQ ID NO: 758701 - protein, 243 aa, Homo sapiens
MGSGYLASFNLSHSVSEALTWSGPPTLEPPEPQRRRGGGSPSAEARRPGPSRSRHRVWALELLPAPRTAGGWQWDRSGGFSRAVPRLAPCEGSERPLSRAVPRDIQKTRNLRNKVAASDRGPGGRGASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 758702 - protein, 269 aa, Homo sapiens
MCLAGCTPRKAAAPGRGALPRARLPRTAPAAATMFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVRRVGVGLSDPQPSCCPGGGFQSLRAGRLPELRE

SEQ ID NO: 758703 - protein, 203 aa, Homo sapiens
MCLAGCTPRKAAAPGRGALPRARLPRTAPAAATMFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQGECPRCARRGGRPAPVLRRCGGGSGARGAV

SEQ ID NO: 758704 - protein, 120 aa, Homo sapiens
MQAASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 758705 - protein, 70 aa, Homo sapiens
RKSHEGRVLLLARPLVKVWFQNRRTKYKRQKLEEEGPESEQKKKGSHHINRWRIATKQANGEDIDVTSND

SEQ ID NO: 758706 - protein, 290 aa, Homo sapiens
MCLAGCTPRKAAAPGRGALPRARLPRTAPAAATMFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 758707 - protein, 422 aa, Homo sapiens
PPALCAARGPGPPAPRLGSGAAADPPGLRAPRPPGRPRLLPSSASASSCRRAGGLQPPSALACQLPRRASVLRPPGPASQPASRAGGGHQAVPMPEPGPRMNGFSLGELCWLFCCPPCPSRIAAKLAFLPPEPTYTVLAPEQRGAGASAPAPAQATAAAAAAQPAPQQPEEGAGAGPGACSLHLSERADWQYSQRELDAVEVFFSRTARDNRLGCMFVRCAPSSRYTLLFSHGNAVDLGQMCSFYIGLGSRINCNIFSYDYSGYGVSSGKPSEKNLYADIDAAWQALRTRYGVSPENIILYGQSIGTVPTVDLASRYECAAVILHSPLMSGLRVAFPDTRKTYCFDAFPSIDKISKVTSPVLVIHGTEDEVIDFSHGLAMYERCPRAVEPLWVEGAGHNDIELYAQYLERLKQFISHELPNS

SEQ ID NO: 758708 - protein, 93 aa, Homo sapiens
LIFLTRSFSGASLRTHARPLDIDKISKVTSPVLVIHGTEDEVIDFSHGLAMYERCPRAVEPLWVEGAGHNDIELYAQYLERLKQFISHELPNS

SEQ ID NO: 758709 - protein, 422 aa, Homo sapiens; identical to SEQ ID NO: 758707

SEQ ID NO: 758710 - protein, 422 aa, Homo sapiens; identical to SEQ ID NO: 758707

SEQ ID NO: 758711 - protein, 422 aa, Homo sapiens; identical to SEQ ID NO: 758707

SEQ ID NO: 758712 - protein, 301 aa, Homo sapiens
SRVNVNDRAGVIVRTWLAVVLHLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKGLNNPKDKAQTPGEEDDHQQWLNVKKQNEGFRSADPDAGGGSWSPNPRQSAL

SEQ ID NO: 758713 - protein, 309 aa, Homo sapiens
MPRSFEQVIILKKWFLKPYKGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKGLNNPKDKAQTPGEEDDHQQWLNVKKQNEGFRSADPDAGGGSWSPNPRQSAL

SEQ ID NO: 758714 - protein, 434 aa, Homo sapiens
MEDFIVISDDSGSESSGGALPGPVAEAAPGPVREPPALLPRRTVNKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKGLNNPKDKAQNPGEEDDHQQWLDVEKQNEGFRSADPDAGGGSWSPNPRQSAL

SEQ ID NO: 758715 - protein, 174 aa, Homo sapiens
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELAETTTASSSTFASS

SEQ ID NO: 758716 - protein, 110 aa, Homo sapiens
LSSSFFKGPALKTRRTQSPKLGHEALALTPRDAVSLPEAAHQSRQRTQVPWGHDVGLRGRPGAGRLPVSWVRCCSALQLWSHAVPAEARSRNAAFGDFNFTFLLLSITKS

SEQ ID NO: 758717 - protein, 116 aa, Homo sapiens
MGVGIWGARRAQRDGDRPVVRPKCRLGTGSGANHRAPTPARVWAARGRQEWPGACVRLACGLTLWVAPALAMAFPFAPIPGSSEARFGRGPSLGTETVPERTLEPAESLHSASIQV

SEQ ID NO: 758718 - protein, 121 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEECK

SEQ ID NO: 758719 - protein, 154 aa, Homo sapiens
LSLACGSKQILSQRGTGTLCADSWLDLYRIGCMLLELAGQEALKPAGAIYMEKSGCSPFPVCWAKEYDRYLASSKIMAAAYLDPNLNHTPNSSTKTHLGTGMERSPGAMERVLKVFHYFESNSEPTTWASIIRHGDATDVRVSTFFHETSLMFI

SEQ ID NO: 758720 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758721 - protein, 883 aa, Homo sapiens
GVKAMSDYWVVGKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEACHYTSLHWNWCRYISDPNVDACPDPRNAELTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758722 - protein, 841 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLMQCGKTVL

SEQ ID NO: 758723 - protein, 1052 aa, Homo sapiens; identical to SEQ ID NO: 758720

SEQ ID NO: 758724 - protein, 1052 aa, Homo sapiens; identical to SEQ ID NO: 758720

SEQ ID NO: 758725 - protein, 381 aa, Homo sapiens
MCCLSSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758726 - protein, 297 aa, Homo sapiens
MAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758727 - protein, 235 aa, Homo sapiens
RSLSTQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758728 - protein, 115 aa, Homo sapiens
MSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758729 - protein, 1052 aa, Homo sapiens; identical to SEQ ID NO: 758720

SEQ ID NO: 758730 - protein, 1052 aa, Homo sapiens; identical to SEQ ID NO: 758720

SEQ ID NO: 758731 - protein, 845 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLVIVFLKGFFDFL

SEQ ID NO: 758732 - protein, 1052 aa, Homo sapiens; identical to SEQ ID NO: 758720

SEQ ID NO: 758733 - protein, 1052 aa, Homo sapiens; identical to SEQ ID NO: 758720

SEQ ID NO: 758734 - protein, 1052 aa, Homo sapiens; identical to SEQ ID NO: 758720

SEQ ID NO: 758735 - protein, 360 aa, Homo sapiens
MESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758736 - protein, 360 aa, Homo sapiens; identical to SEQ ID NO: 758735

SEQ ID NO: 758737 - protein, 1018 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEIEMAQKLLNSDLGELINKMKLAQQYVMTSLQQEYKKQMLTAAHALAVDAKNLLDVIDQARLKMLGQTRPH

SEQ ID NO: 758738 - protein, 1060 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVMIGCTMCCGLGYNQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758739 - protein, 399 aa, Homo sapiens
MYMLDKVLRGISQRNSVLLKINFCTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758740 - protein, 1027 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKNYSMSLTKQD

SEQ ID NO: 758741 - protein, 367 aa, Homo sapiens
SQPAPPEEYVPMVKEVGLSLRTLWDTVDETIPLLPASTHREIEMAQKLLNSDLGELINKMKLAQQYVMTAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 758742 - protein, 115 aa, Homo sapiens; identical to SEQ ID NO: 758728

SEQ ID NO: 758743 - protein, 906 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKVGI

SEQ ID NO: 758744 - protein, 750 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVCQSLQI

SEQ ID NO: 758745 - protein, 300 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 758746 - protein, 278 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 758747 - protein, 204 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 758748 - protein, 266 aa, Homo sapiens
HRSWNETTCRVSTMDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 758749 - protein, 288 aa, Homo sapiens
HRSWNETTCRVSTMDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 758750 - protein, 252 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 758751 - protein, 191 aa, Homo sapiens
HRSWNETTCRVSTMDPKQTTLLCLGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 758752 - protein, 240 aa, Homo sapiens
HRSWNETTCRVSTMDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 758753 - protein, 164 aa, Homo sapiens
MPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 758754 - protein, 238 aa, Homo sapiens
MPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 758755 - protein, 164 aa, Homo sapiens; identical to SEQ ID NO: 758753

SEQ ID NO: 758756 - protein, 192 aa, Homo sapiens
HRSWNETTCRVSTMDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 758757 - protein, 197 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKDPSKGITGLDLADMKGMGKSPSCA

SEQ ID NO: 758758 - protein, 189 aa, Homo sapiens
HRSWNETTCRVSTMDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKLCLALAPKLGPAVRSF

SEQ ID NO: 758759 - protein, 109 aa, Homo sapiens
RRSSPSGGNQPIHVEVLKSQEPAHRRLPGFESWQVLNSLSLSYSICNRTCLPGIAGKIQGENLGQAIGSQISKSSTGEVPRLGLEPREVRTPGEVRGNPHTGLFHVLFL

SEQ ID NO: 758760 - protein, 546 aa, Homo sapiens
MEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANNCFLPQCPAFHSHLRAMAVTHTLPPPSSTAETGQTTLGNPGASSPLLEMEDQDGILSRLTSRNPQAWELRPGQLDGRELGVAVEKDLGCGLLGLCRQSLQCVHPEDGGSAAVLKTGSQFFTPRFRLPGAVTLLSECLLSPFHSCFSQLCFLWLWPQLIPTERTDLRGCWTWLDRRRGGCLKGTSMGRVERLPQQVIWLLRSGVEEEVDVAAEIYRGHGCGSFYQGLPGDKRVTEETKNKHSPLLWDL

SEQ ID NO: 758761 - protein, 606 aa, Homo sapiens
MGCIGSRTVGNEVIAVDWKGLKDVDQINMDSTSSLHGSSLHRPSTEQTRTDFSWDGINLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANNCFLPQCPAFHSHLRAMAVTHTLPPPSSTAETGQTTLGNPGASSPLLEMEDQDGILSRLTSRNPQAWELRPGQLDGRELGVAVEKDLGCGLLGLCRQSLQCVHPEDGGSAAVLKTGSQFFTPRFRLPGAVTLLSECLLSPFHSCFSQLCFLWLWPQLIPTERTDLRGCWTWLDRRRGGCLKGTSMGRVERLPQQVIWLLRSGVEEEVDVAAEIYRGHGCGSFYQGLPGDKRVTEETKNKHSPLLWDL

SEQ ID NO: 758762 - protein, 557 aa, Homo sapiens
VVDLAGSYVIPFVCQSPFQRKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANNCFLPQCPAFHSHLRAMAVTHTLPPPSSTAETGQTTLGNPGASSPLLEMEDQDGILSRLTSRNPQAWELRPGQLDGRELGVAVEKDLGCGLLGLCRQSLQCVHPEDGGSAAVLKTGSQFFTPRFRLPGAVTLLSECLLSPFHSCFSQLCFLWLWPQLIPTERTDLRGCWTWLDRRRGGCLKGTSMGRVERLPQQVIWLLRSGVEEEVDVAAEIYRGHGCGSFYQGLPGDKRVTEETKNKHSPLLWDL

SEQ ID NO: 758763 - protein, 175 aa, Homo sapiens [sequence omitted]

SEQ ID NO: 758764 - protein, 606 aa, Homo sapiens; identical to SEQ ID NO: 758761

SEQ ID NO: 758765 - protein, 175 aa, Homo sapiens [sequence omitted]

SEQ ID NO: 758766 - protein, 216 aa, Homo sapiens
GKKHGLKMLERSFSARRSKRNRKCPVKFDDTSDDEQESGDGSDNLNQENFDKEKSDRNDSEDPGSEYNAEEDELEEEMSDEYSDIEEQSEKDHNDAEEEPEAGDSVGNVHEGLTPVVIQNSNKKILQCPKCDKTFDRIGKYESHTRVHTGEKPFECDICHQRYSTKSNLTVHRKKHSNETEFHKKEHKCPYCNKLHASKKTLAKHVKRQVLSCFHN

SEQ ID NO: 758767 - protein, 396 aa, Homo sapiens
MLITVYCVRRDLSEVTFSLQVSPDFELRNFKVLCEAESRVPVEEIQIIHMERLLIEDHCSLGSYGLKDGDIVVLLQKDNVGPRAPGRAPNQPRVDFSGIAVPGTSSSRPQHPGQQQQRTPAAQRSQGLASGEKVAGLQGLGSPALIRSMLLSKPHDLSLLKERKPPLAEALLSGSLETFSQVLMEQQREKALREQERLRLYTADPLDREAQAKIEEEIRQQNIEENMNIAIEEAPESFGQVTMLYINCKVNGHPLKAFVDSGAQMTIMSQACAERCNIMRLVDRRWAGVAKGVGTQRIIGRVHLAQIQIEGDFLQCSFSILEDQPMDMLLGLDMLRRHQCSIDLKKNVLVIGTTGTQTYFLPEGELPLCSRMVSGQDESSDKEITHSVMDSGRKEH

SEQ ID NO: 758768 - protein, 113 aa, Homo sapiens
ICKPLHYTTIMQQGICHLLVVIAWIGGILHATVQILFMTDLPFVVPNVIDHFMCDLFPLLKLACRDTYRLGMLVAANSGAMCLLIFSLLVISYIVILSSLKSYSSEGQHKALS

SEQ ID NO: 758769 - protein, 559 aa, Homo sapiens
RKTGSRRHPLGLTKMLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPWQGSLGLQYNASQEWDLRSSCGSLRLTVSIEARAAGP

SEQ ID NO: 758770 - protein, 150 aa, Homo sapiens
RKTGSRRHPLGLTKMLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNNCQPENV

SEQ ID NO: 758771 - protein, 559 aa, Homo sapiens; identical to SEQ ID NO: 758769

SEQ ID NO: 758772 - protein, 193 aa, Homo sapiens
APGNSLETRVLGLRPDPPNRNSCGARCQPEGPAVQGSPDISHLRTEAARSGEPGQGHGRERPDSGSLGPSPHSAPSESKVPCREGPSTLPIPYWLHPLKPRPAACRTSPRHQVVPGASLMPGPGETCGHRTHVLPGDGQEAPLLRRSCRFFFLNTVCPSLHPPSHLCPSLQQSFRQAGPAPCLPLLPPPTHTF

SEQ ID NO: 758773 - protein, 113 aa, Homo sapiens
APGNSLETRVLGLRPDPPNRNSCGARCQPEGPAVQGSPDISHLRTEAARSGEPGQGHGRERPDSGSLGPSPHSAPSESKVPCREGPSTLVSATAHFAQVKDAALARVAHDLHF

SEQ ID NO: 758774 - protein, 385 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758775 - protein, 385 aa, Homo sapiens; identical to SEQ ID NO: 758774

SEQ ID NO: 758776 - protein, 431 aa, Homo sapiens
LVANSARGFLRPGNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758777 - protein, 429 aa, Homo sapiens
KGAPWTLSAIRMQPEGIIFEAENKPSPGTESAGTFILDLSATSRTIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758778 - protein, 349 aa, Homo sapiens
MLDPKCDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758779 - protein, 289 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGICICNELWCFLSIKVYLCPSYKIKGKKKHLK

SEQ ID NO: 758780 - protein, 447 aa, Homo sapiens
MTAKNVGLTSTNAEVRGFIDQNLSPTKGSNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758781 - protein, 438 aa, Homo sapiens
CFGASRYSDMYNSNYAGFTSNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758782 - protein, 385 aa, Homo sapiens; identical to SEQ ID NO: 758774

SEQ ID NO: 758783 - protein, 424 aa, Homo sapiens
MLDPKWMQPEGIIFEAENKPSPGTESAGTFILDLSATSRTIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758784 - protein, 402 aa, Homo sapiens
SVVECCWYCSERHASLDQIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 758785 - protein, 339 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSRYVFFSGLERQTPEP

SEQ ID NO: 758786 - protein, 259 aa, Homo sapiens
MDAWVRFSAQSQARERLCRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 758787 - protein, 228 aa, Homo sapiens
MASTRLGCWLQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 758788 - protein, 245 aa, Homo sapiens
MGKLRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 758789 - protein, 176 aa, Homo sapiens
MPLSQPHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 758790 - protein, 259 aa, Homo sapiens; identical to SEQ ID NO: 758786

SEQ ID NO: 758791 - protein, 259 aa, Homo sapiens; identical to SEQ ID NO: 758786

SEQ ID NO: 758792 - protein, 251 aa, Homo sapiens
MPFPSSGLEKWAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 758793 - protein, 124 aa, Homo sapiens
RDHSRAEIKGCFLFLLKPGCFFGVHPPEPGAQALAESRDCFRKAHLPSVGRQPGHLNSTAEAASLNLLILQRIDLYQLIRERKKNHLVILNHMRSPVPSANNCKEMQLEECIEITTGSSFLMRK

SEQ ID NO: 758794 - protein, 468 aa, Homo sapiens
MEPPPSSPTLSAAASATLASSCGEAVASGLQPAVRRLLQVKPEQVLLLPQPQAQNEEAAASSAQARLLQFRPDLRLLQPPTASDGATSRPELHPVQPLALHVKAKKQKLGPSLDQSVGPRGAVETGPRASRVVKLEGPGPALGYFRGDEKGKLEAEEVMRDSMQGGAGKSPAAIREGVIKTEEPERLLEDCRLGAEPASNGLVHGSAEVILAPTSGAFGPHQQDLRIPLTLHTVPPGARIQFQGAPPSELIRLTKVPLTPVPTKMQSLLEPSVKIETKDVPLTVLPSDAGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVVHALTVGLPLAMEIFRVQCQNALVIMKTGTQNMRVSFQL

SEQ ID NO: 758795 - protein, 104 aa, Homo sapiens
MVGLLSGMELRSEDPAQAIPFCDETIAMETKVLGQRGLRLQDQDWCLSGRPLAKASRSGCFLNESAISCGVLTPSRRRSLFQCQLPRETYLAHPYKWCLALVNS

SEQ ID NO: 758796 - protein, 734 aa, Homo sapiens
MEPPPSSPTLSAAASATLASSCGEAVASGLQPAVRRLLQVKPEQVLLLPQPQAQNEEAAASSAQARLLQFRPDLRLLQPPTASDGATSRPELHPVQPLALHVKAKKQKLGPSLDQSVGPRGAVETGPRASRVVKLEGPGPALGYFRGDEKGKLEAEEVMRDSMQGGAGKSPAAIREGVIKTEEPERLLEDCRLGAEPASNGLVHGSAEVILAPTSGAFGPHQQDLRIPLTLHTVPPGARIQFQGAPPSELIRLTKVPLTPVPTKMQSLLEPSVKIETKDVPLTVLPSDAGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVGETSPAIQLPTPAVQSPSPVTLFQPSVSSAAQVAVQDPSLPVYPALPPQRFTGPSQTDTHQLHSEATHTVKQPTPVSLESANRISSSASTAHARFATSTIQPPREYSSVSPCPRSAPIPQGAFLSPPQFSTNPTIWLTPGPPFPPLGPIPGPALVFGTPPRFSFHHPYFLPGPHYFPSSTCPYSRPPFGYGNFPSSMPECLSYYEDRYPKHEGIFSTLNRDYSFRDYSSECTHSENSRSCENMNGTSYYNSHSHSGEENLNPVPQLDIGTLENVFTAPTSTPSSIQQVNVTDSDEEEEEKVLRDL

SEQ ID NO: 758797 - protein, 104 aa, Homo sapiens; identical to SEQ ID NO: 758795

SEQ ID NO: 758798 - protein, 753 aa, Homo sapiens [sequence omitted]

SEQ ID NO: 758799 - protein, 753 aa, Homo sapiens [sequence omitted]

SEQ ID NO: 758800 - protein, 448 aa, Homo sapiens
MEKCCRGKEQSLLCIQQGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVGETSPAIQLPTPAVQSPSPVTLFQPSVSSAAQVAVQDPSLPVYPALPPQRFTGPSQTDTHQLHSEATHTVKQPTPVSLESANRISSSASTAHARFATSTIQPPREYSSVSPCPRSAPIPQASPIPHPHVYQPPPLGHPATLFGTPPRFSFHHPYFLPGPHYFPSSTCPYSRPPFGYGNFPSSMPECLSYYEDRYPKHEGIFSTLNRDYSFRDYSSECTHSENSRSCENMNGTSYYNSHSHSGEENLNPVPQLDIGTLENVFTAPTSTPSSIQQVNVTDSDEEEEEKVLRDL

SEQ ID NO: 758801 - protein, 233 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGNIPSEASGLYKGGEEPVTTQPSVGHAVPAPKSQTEGR

SEQ ID NO: 758802 - protein, 247 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCVYTLQWDCWIYGSSIFSFLRNNLQTVLHSGCTNLHSHQQCTKIPFSPGQVLNGCKLMSNVFGASDK

SEQ ID NO: 758803 - protein, 224 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRVGNIHTRSGHPFHPWLLELPSDLSVPQPR

SEQ ID NO: 758804 - protein, 212 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRAQLQNLPAVPIHHLQAP

SEQ ID NO: 758805 - protein, 215 aa, Homo sapiens
MSAKRAELKKTHLVKERHCWTSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGIYAAVGLLDLW

SEQ ID NO: 758806 - protein, 207 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGIYAAVGLLDLW

SEQ ID NO: 758807 - protein, 243 aa, Homo sapiens
AGSGLRWGAESILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWERGDSNSDDYDLESNMSNGWDPNEMFKFNEENYGVKTTYDSSLSSYTVPLEKDNSEEFRQRELRAAQLAPEIESSP

SEQ ID NO: 758808 - protein, 222 aa, Homo sapiens
AGSGLRWGAESILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKSNGWDPNEMFKFNEENYGVKTTYDSSLSSYTVPLEKDNSEEFRQRELRAAQLAPEIESSP

SEQ ID NO: 758809 - protein, 99 aa, Homo sapiens
KGIVGVEDDTMAGKLRVVGDVGRIGRGGKSEGYELESDMSNGWDPNEMFKFNEENYGVKTTYDSSLSSYTVPLEKDNSEEFRQRELRAAQLAPEIESSP

SEQ ID NO: 758810 - protein, 504 aa, Homo sapiens
MSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 758811 - protein, 504 aa, Homo sapiens; identical to SEQ ID NO: 758810

SEQ ID NO: 758812 - protein, 343 aa, Homo sapiens
MGALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGYRRIPLFSRMGESLEPASLFVYVWYVR

SEQ ID NO: 758813 - protein, 204 aa, Homo sapiens
MSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPELLVQDGMKHSHLLFMSQNWH

SEQ ID NO: 758814 - protein, 420 aa, Homo sapiens
MGALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 758815 - protein, 480 aa, Homo sapiens
MSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 758816 - protein, 125 aa, Homo sapiens
MLSVQPDTKPKGCAGCNRKIKDRYLLKALDKYWHEDCPKCACCDCRWERLFGVTGNCAACSKLIPAFEMVMRAKDNVYHLDCFACQLCNQRFCVGDKFFLKNNMILCQTDYEEGLMKEGYAPQVR

SEQ ID NO: 758817 - protein, 145 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 758818 - protein, 145 aa, Homo sapiens; identical to SEQ ID NO: 758817

SEQ ID NO: 758819 - protein, 125 aa, Homo sapiens; identical to SEQ ID NO: 758816

SEQ ID NO: 758820 - protein, 145 aa, Homo sapiens; identical to SEQ ID NO: 758817

SEQ ID NO: 758821 - protein, 145 aa, Homo sapiens; identical to SEQ ID NO: 758817

SEQ ID NO: 758822 - protein, 125 aa, Homo sapiens; identical to SEQ ID NO: 758816

SEQ ID NO: 758823 - protein, 205 aa, Homo sapiens
TRVLVCLCASVCIMYACVCTPVHVAIWACTRVVRYMYVCVLLFMHVGGCACICVRGHGLQLGNLSVGPGPLRDPGLPAGCGQPRSPLTPCRRLVAEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 758824 - protein, 240 aa, Homo sapiens
PTSGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 758825 - protein, 130 aa, Homo sapiens
MIFPPSSRDQRELIECDNDSLAGTAEASGSFLRSAVKEDEKHGYALLLVPLFLYLISTSFYKYIRATLSLCISNKAKRGCNYTLLQSSVSPGNRNAKALKASLFADMVSWVPWAKSFCCPPLSPSKLGPF

SEQ ID NO: 758826 - protein, 130 aa, Homo sapiens; identical to SEQ ID NO: 758825

SEQ ID NO: 758827 - protein, 100 aa, Homo sapiens
LFQVINTLADHHHCGTGFRGSPWLHFIIAFPRSYKVFIILWTVYLWMSLLKTILWSRNGHDGSTDVQQRAWRSNRCRQKGNKIGLKDVITLWRHVETKVR

SEQ ID NO: 758828 - protein, 799 aa, Homo sapiens
DLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLDSSFCRPTEQAKAEMCKVPFPRQLECVMKMEISET

SEQ ID NO: 758829 - protein, 797 aa, Homo sapiens
DLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLEKIKMAEEKGKQV

SEQ ID NO: 758830 - protein, 1487 aa, Homo sapiens
DLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLVQIWIGNNLREDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 758831 - protein, 1478 aa, Homo sapiens
DLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLEKIKMAEEKGKQVYKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 758832 - protein, 58 aa, Homo sapiens
MSNSPEGTYGVELAVQFGRRVGCAQRSYAKGSWTGGLCSGKEISIPCTILVVEEPLID

SEQ ID NO: 758833 - protein, 103 aa, Homo sapiens
KNTLERALPSFIYIILEMDFRVSTGFLQNSSPGGARSPQASRIAVCFVPSLPNRFALFKGPTFRAAKDFLRAAPWSLRQPGMAFILGPGCGEVLTSLGVRGGG

SEQ ID NO: 758834 - protein, 402 aa, Homo sapiens
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 758835 - protein, 106 aa, Homo sapiens
SASTFFGGSRSSGSARRARAHDVEMVGQLVGIMVVSCICWSPMLVRGAPAPRATLLPAPSRHPPALCRPRTPGASILDSTKAPAPRGPTCPESQHRLLHLTSHPSS

SEQ ID NO: 758836 - protein, 360 aa, Homo sapiens
MTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 758837 - protein, 132 aa, Homo sapiens [sequence omitted]

SEQ ID NO: 758838 - protein, 925 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKGSCYVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 758839 - protein, 921 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISGCTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 758840 - protein, 847 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISGCTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPGESERCLNLQRGFYLVQMTPGLHLIIFHTISDLNLTEPLPLKCTKVNQRDE

SEQ ID NO: 758841 - protein, 318 aa, Homo sapiens
MRRNTKGKRISSLPLVNRNGWNVEYQDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 758842 - protein, 284 aa, Homo sapiens
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 758843 - protein, 270 aa, Homo sapiens
PLGLATLSSEYACSDFLSLSILPYSEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 758844 - protein, 261 aa, Homo sapiens
PLGLATLSSEYACSDFLSLSILPYSEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGPKRGEHAWTHRLRERKQLVIYEEISDPEEDDE

SEQ ID NO: 758845 - protein, 235 aa, Homo sapiens
PLGLATLSSEYACSDFLSLSILPYSEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 758846 - protein, 217 aa, Homo sapiens
PLGLATLSSEYACSDFLSLSILPYSEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGVLQRYCRFSSRPLQ

SEQ ID NO: 758847 - protein, 206 aa, Homo sapiens
PPTLQPPALQPTPLPVAPPLTPGLGHKESALAPTAAPALPPALAADQAPAPSPAPAPTVAEPSPPVSAPAPALRPSRPARAGTRVPVQPGARPVRMACMEMVLANELQLPCLTAVVEGVVAAGPLRLGQLTTRARHWLPFQVLNSCPCKCYCHHQPRHRRLPRNVSAWLSTSTNHLGEPPWVATIKLSGSLVAKLEHYDLQATHSN

SEQ ID NO: 758848 - protein, 224 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHA

SEQ ID NO: 758849 - protein, 338 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPACVRARTRGCAHQDPHAQEQGFPCSPGRDPYRMACMEMVLANELQLPCLTAVVEGVVAAGPLRLGQLTTRARHWLPFQVLNSCPCKCYCHHQPRHRRLPRNVSAWLSTSTNHLGEPPWVATIKLSGSLVAKLEHYDLQATHSN

SEQ ID NO: 758850 - protein, 105 aa, Homo sapiens
NQKAWGRGTRPRSISRGDLVPCPAPGPGRRGLNSARLEDSVLNSCPCKCYCHHQPRHRRLPRNVSAWLSTSTNHLGEPPWVATIKLSGSLVAKLEHYDLQATHSN

SEQ ID NO: 758851 - protein, 422 aa, Homo sapiens
YGYEYLGNSPRLVITPLTDRCYRTLMGALKLNLGGAPEGPAGTGKTETTKDLAKALAKQCVVFNCSDGLDYKAMGKFFKGLAQAGAWACFDEFNRIEVEVLSVVAQQILSIQQAIIRKLKTFIFEGTELSLNPTCAVFITMNPGYAGRAELPDNLKALFRTVAMMVPDYALIGEISLYSMGFLDSRSLAQKIVATYRLCSEQLSSQHHYDYGMRAVKSVLTAAGNLKLKYPEENESVLLLRALLDVNLAKFLAQDVPLFQGIISDLFPGVVLPKPDYEVFLKVLNDNIKKMKLQPVPWFIGKIIQIYEMMLVRHGYMIVGDPMGGKTSAYKVLAAALGDLHAANQMEEFAVEYKIINPKAITMGQLYGCFDQVSHEWMDGVLANAFREQASSLSDDRKWIIFDGPVDAIWIENMNTVLDDNK

SEQ ID NO: 758852 - protein, 613 aa, Homo sapiens
FRGAGGRAGGRDRRRRRRRRRLTDNEGGGAALSGGGGGGGGERRGARGRGGAPAMDNQCTVQVRLELGHRAQLRKKPTTEGFTHDWMVFVRGPEQCDIQHFVEKVVFWLHDSFPKPRRVCKEPPYKVEESGYAGFIMPIEVHFKNKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPNPGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 758853 - protein, 153 aa, Homo sapiens
FRGAGGRAGGRDRRRRRRRRRLTDNEGGGAALSGGGGGGGGERRGARGRGGAPAMDNQCTVQVRLELGHRAQLRKKPTTEGFTHDWMVFVRGPEQCDIQHFVEKVVFWLHDSFPKPRRVCKEPPYKVEESGYAGFIMPIEVHFKNICVLPSLL

SEQ ID NO: 758854 - protein, 498 aa, Homo sapiens
TLNILSTLSNGNSSKQKIPADGVHRIRVDFKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPNPGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 758855 - protein, 86 aa, Homo sapiens
YPMLPTIPLSAFSDPKKTKPSHGSKVSEAEGPVAWERRGPAVVGLAPAPSLHWAGPSAPARSLGVFLFELSAHPSLRTAASLGFQE

SEQ ID NO: 758856 - protein, 85 aa, Homo sapiens
QAPRLWQLASTPLRMCVNSRVGCWGCGFRLTPQAPHLLVFRWSGTLVILTEKFQPKRKLMLCLSVEQNPPPAILIFKQVPHQPLF

SEQ ID NO: 758857 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 758858 - protein, 297 aa, Homo sapiens
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQMVDIHVTLTEKELQELTKPKESSRETTPEGRMACQMGADRGPHVVLWTLICLPVVFILSFVVSFYYGTITWYNIFLVYNEERTFWHKISYCPCLVLFYPVLIMAMASSLGLYAAVVQLSWSWEAWWQAARDMEKGFCGWLCSKLGLEDCSPYSIVELLESDNISSTLSNKDPIQEVETSTV

SEQ ID NO: 758859 - protein, 297 aa, Homo sapiens; identical to SEQ ID NO: 758858

SEQ ID NO: 758860 - protein, 169 aa, Homo sapiens
MKGSRIELGDVTPHNIKQLKRLNQVIFPVSYNDKFYKDVLEVGELAKLAYFNDIAVGAVCCRVDHSQNQKRLYIMTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 758861 - protein, 169 aa, Homo sapiens; identical to SEQ ID NO: 758860

SEQ ID NO: 758862 - protein, 169 aa, Homo sapiens; identical to SEQ ID NO: 758860

SEQ ID NO: 758863 - protein, 169 aa, Homo sapiens; identical to SEQ ID NO: 758860

SEQ ID NO: 758864 - protein, 169 aa, Homo sapiens; identical to SEQ ID NO: 758860

SEQ ID NO: 758865 - protein, 169 aa, Homo sapiens; identical to SEQ ID NO: 758860

SEQ ID NO: 758866 - protein, 169 aa, Homo sapiens; identical to SEQ ID NO: 758860

SEQ ID NO: 758867 - protein, 130 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKT

SEQ ID NO: 758868 - protein, 409 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 758869 - protein, 409 aa, Homo sapiens; identical to SEQ ID NO: 758868

SEQ ID NO: 758870 - protein, 286 aa, Homo sapiens [sequence omitted]

SEQ ID NO: 758871 - protein, 391 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 758872 - protein, 409 aa, Homo sapiens; identical to SEQ ID NO: 758868

SEQ ID NO: 758873 - protein, 322 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREIVTKSV

SEQ ID NO: 758874 - protein, 409 aa, Homo sapiens; identical to SEQ ID NO: 758868

SEQ ID NO: 758875 - protein, 124 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERAPELLLRSLPCRTDELPMRTA

SEQ ID NO: 758876 - protein, 409 aa, Homo sapiens; identical to SEQ ID NO: 758868

SEQ ID NO: 758877 - protein, 303 aa, Homo sapiens
VERTNLIPCAFVFQRALNSYFEPPVEESALERRPETISEPKTYVDLTNEETTDSTTSKISPSEDTQQENLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 758878 - protein, 263 aa, Homo sapiens
RSCTSFPRAAHFPAGRLMRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHPRGL

SEQ ID NO: 758879 - protein, 263 aa, Homo sapiens; identical to SEQ ID NO: 758878

SEQ ID NO: 758880 - protein, 230 aa, Homo sapiens
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFKALLQLDPCENKIKWINFLALGCSMLGGSLNTALKHLCEILTDDPEGGPARIPFKTFSYVYRYLARLDSDVSPLETESYLASLKENIDARKNGMIGLSDFFFPKRKLLESIENSEDVGH

SEQ ID NO: 758881 - protein, 230 aa, Homo sapiens; identical to SEQ ID NO: 758880

SEQ ID NO: 758882 - protein, 230 aa, Homo sapiens; identical to SEQ ID NO: 758880

SEQ ID NO: 758883 - protein, 241 aa, Homo sapiens
MMPPRMQATAPGAGAQVIRQPPPPFLCQWSLRSVPCPTCPSRPRLLVPSTSFPLLPSNSHPLCPPWAEPLDSMVPLFPPSSVIHCHSNPPVLVEDRSSQAIPSVRLILDTILAGVCSHMDDTVLCPQLSSWCPQPLLLHRHPGHAGPLLLPDPRTSSLLLCSLMRLLRLTEPPGTWVVPSHSKSMSQASKELGPCAAATSPTTFLRSQVIKKEKPMHIAPIFSPRNKATFIIRFGALCTRK

SEQ ID NO: 758884 - protein, 230 aa, Homo sapiens; identical to SEQ ID NO: 758880

SEQ ID NO: 758885 - protein, 304 aa, Homo sapiens
GGAGVQRPGSVCSRCPAEVCRPHTPAHSSRGEARLVISSEHVVRLLRESECRFARRPSVRALSRSQHSSPELHGQYAGMPSCDHRELRIRDSQPGWTVRSALVRGGRNFVHGVWSMERGSSFAAKWTRDVKMPYGHSQQQQTPGSASQGTPEGFWHYSYCHHKRYVELTDLEQKWKNLCLPKEKFKALLQLDPCENKIKWINFLALGCSMLGGSLNTALKHLCEILTDDPEGGPARIPFKTFSYVYRYLARLDSDVSPLETESYLASLKENIDARKNGMIGLSDFFFPKRKLLESIENSEDVGH

SEQ ID NO: 758886 - protein, 158 aa, Homo sapiens
RPQTFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 758887 - protein, 260 aa, Homo sapiens
TAGGRPSSGSRQRFQVQFQGLAGSPSRRARSGQRGPDRRLLWGPRSWEAASGSPRRRMGCRHSRLSSCKPPKKKRQEPEPEQPPRPEPHELGPLNGDTAITVQLCASEEAERHQKDITRILQQHEEEKKKWAQQVEKERELELRDRLDEQQRVLGTGASLVVVSPFIYQSWNLIPAQMRKPRHGAVPRVESRSHLSSGSYPLLCFSLQALENQICDLIFLSLALTHLVSFSFLLPALTPPPTAPDPRPRLLQPGAQLPHQ

SEQ ID NO: 758888 - protein, 194 aa, Homo sapiens
GGRPPQLRLKTALPGSVSGSRRQPQPAGAERAAGPGSQAPLGAPELGSGVREPPEEDGLQTQQAEQLQTPEKGKGRRRRSLLSEERGVRNRSAAEDSAPRALSGRPGIPDGEPGEASSETREALLGGALYPGPSRTKQPSLQTRHPGQGKAADSRCLGWGDVVCLWQVPSAFGLGLFAVWPWTSDLTSLGLRLP

SEQ ID NO: 758889 - protein, 353 aa, Homo sapiens
TAGGRPSSGSRQRFQVQFQGLAGSPSRRARSGQRGPDRRLLWGPRSWEAASGSPRRRMGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 758890 - protein, 270 aa, Homo sapiens
TAGGRPSSGSRQRFQVQFQGLAGSPSRRARSGQRGPDRRLLWGPRSWEAASGSPRRRMGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELEREKSDIGGKNYDPATGK

SEQ ID NO: 758891 - protein, 258 aa, Homo sapiens
SWCCCCEDIIQEYKNIAFYVKSKVRRSCYESPEKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 758892 - protein, 135 aa, Homo sapiens
HFGRLRRADHLRSGVQDQLGQHGKTLSLLKIQKLDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 758893 - protein, 353 aa, Homo sapiens; identical to SEQ ID NO: 758889

SEQ ID NO: 758894 - protein, 160 aa, Homo sapiens
TAGGRPSSGSRQRFQVQFQGLAGSPSRRARSGQRGPDRRLLWGPRSWEAASGSPRRRMGCRHSRLSSCKPPKKKRQEPEPEQPPRPEPHELGPLNGDTAITVQLCASEEAERHQKDITRILQQHEEEKKKWAQQVSPGAPTPCLSPAQLTLVNPRVSAYP

SEQ ID NO: 758895 - protein, 213 aa, Homo sapiens
TAGGRPSSGSRQRFQVQFQGLAGSPSRRARSGQRGPDRRLLWGPRSWEAASGSPRRRMGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQGKGRDVPLAKVVGGASFWPHLPSSPGHSHCSLPVCLIHKQLTQIYRILGP

SEQ ID NO: 758896 - protein, 127 aa, Homo sapiens
MGRKEHESPSQPHMCGWEDSQKPSVPSHGPKTPSCKGVKAPHSSRPRAWKQDLEQSLAAAYVPVVVDSKGQNPDKLRFNFYTSQYSNSLNPFYTLQKPTCGYLYRRDTDHTRKRFDVPPANLVLWRS

SEQ ID NO: 758897 - protein, 201 aa, Homo sapiens
MGNVMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 758898 - protein, 201 aa, Homo sapiens; identical to SEQ ID NO: 758897

SEQ ID NO: 758899 - protein, 166 aa, Homo sapiens
MVFMQQVFFFFMTIRNLKLQSSCSHGDIDIAMGNVMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQVQRARPGCGAAVWGGTRN

SEQ ID NO: 758900 - protein, 87 aa, Homo sapiens
MGNVMEGKSVEELSSTECHQWYKKFMTECPSGQLTLYEFRQFFGLKNLSPSASQYVEQMFETFDFNKATYNILLDMRTGDRQGCLVP

SEQ ID NO: 758901 - protein, 121 aa, Homo sapiens
RPAYFIIMMFVCVSHHELYDVDGNGCIDRDELLTIIQAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 758902 - protein, 201 aa, Homo sapiens; identical to SEQ ID NO: 758897

SEQ ID NO: 758903 - protein, 135 aa, Homo sapiens
MGNVMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQVQRARPGCGAAVWGGTRN

SEQ ID NO: 758904 - protein, 121 aa, Homo sapiens
RSSFTPCSSWGRLGPWVHLGGGGRSPDLTPPRPHPDSPPCPGPQPSQDSARRRALWPEVTEARAAALAGCRELPPHQLVPPRPPPTCLLPACSRLIRPGPLPCQPGWACCGAGAWAVALGF

SEQ ID NO: 758905 - protein, 71 aa, Homo sapiens
KIPEMWLVSLPGSLLEDCPVPHASVGQGASPGFRIMLLLPADATISDHGLIRLLFKNCLRCSSDPEFQQES

SEQ ID NO: 758906 - protein, 418 aa, Homo sapiens
MIHSLFLINCSGDIFLEKHWKSVVSQSVCDYFFEAQEKAADVENVPPVISTPHHYLISIYRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNMNLTPTQGSYTFDPVTKVLTWDVGKITPQKLPSLKGLVNLQSGAPKPEENPSLNIQFKIQQLAISGLKVNRLDMYGEKYKPFKGVKYVTKAGKFQVRT

SEQ ID NO: 758907 - protein, 418 aa, Homo sapiens; identical to SEQ ID NO: 758906

SEQ ID NO: 758908 - protein, 392 aa, Homo sapiens
MIHSLFLINCSGDIFLEKHWKSVVSQSVCDYFFEAQEKAADVENVPPVISTPHHYLISIYRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNMNLTPTQGSYTFDPVTKVLTWDVGKITPQKLPSLKGLVNLQSGAPKPEENPSLNIQFKIQQLAISGKDKVDL

SEQ ID NO: 758909 - protein, 418 aa, Homo sapiens; identical to SEQ ID NO: 758906

SEQ ID NO: 758910 - protein, 360 aa, Homo sapiens
MLRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNMNLTPTQGSYTFDPVTKVLTWDVGKITPQKLPSLKGLVNLQSGAPKPEENPSLNIQFKIQQLAISGLKVNRLDMYGEKYKPFKGVKYVTKAGKFQVRT

SEQ ID NO: 758911 - protein, 418 aa, Homo sapiens; identical to SEQ ID NO: 758906

SEQ ID NO: 758912 - protein, 418 aa, Homo sapiens; identical to SEQ ID NO: 758906

SEQ ID NO: 758913 - protein, 312 aa, Homo sapiens
MIHSLFLINCSGDIFLEKHWKSVVSQSVCDYFFEAQEKAADVENVPPVISTPHHYLISIYRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQKYVDASARICHHTYQVQLTFPCFFLKVEYLRSSLLTLTIAHQETQ

SEQ ID NO: 758914 - protein, 116 aa, Homo sapiens
MSSEETSCNHGWDCPYQEPSAVSAMRGEPHPHETSSWPSSTTLCPSLSLPAEALARQPRCTRSTFTTLSSPKESRLSDCHQRRIIRSSQGCPRHTGTRSSENIRGRCKWIPMPGHL

SEQ ID NO: 758915 - protein, 225 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 758916 - protein, 159 aa, Homo sapiens
MKDIGYSDIMVLCVLKGGYKFCADLVEHLKNISRNSDRFVSMKVDFIRLKSYRNDQSMGEMQIIGGDDLSTLAGKDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 758917 - protein, 208 aa, Homo sapiens
MDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 758918 - protein, 173 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRLRARLKRTTICDRGGLAFSQGYMSSCAPLQESPNTLWRGYLQVLIPCFHIRFQLPRSEQN

SEQ ID NO: 758919 - protein, 190 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDSHMRHQ

SEQ ID NO: 758920 - protein, 221 aa, Homo sapiens
RKVEKGGGRWREIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 758921 - protein, 147 aa, Homo sapiens
KSTVPTWGPWSPGEPMSSESRQLLPSQTPFPPPFLKRPLGSCLQCLFSPSLLNSLSGFWLFLRSHQTKVISSPQDAQCSGWFPVPSPLAHLRQWTLLILLFLEILSTWTPPSPSLCTLPAAPPHPASIPGLCPPHPASIPGLCPLAP

SEQ ID NO: 758922 - protein, 92 aa, Homo sapiens
MTAEPVKNGILAKSQPNMDQECDVVLNSSIQNKTALFNCLPWSVMAVLTVIVCEEKLKKSEVFRLEDANSRILETAEHNNAIRVKNELVLIV

SEQ ID NO: 758923 - protein, 47 aa, Homo sapiens
MNCIGLYQNEQESKLTGIKRMLCTQRGYFNKIFVNIFRCKIKCVPWI

SEQ ID NO: 758924 - protein, 110 aa, Homo sapiens
HILRGRLCAQPQGPHTHTICSASQTCTSPTKPAPIEAHTSMHSQCAECHSSVHTHTHAYLLKHAYWFTLTEEYICTHICIDMQVHVLRPVQRYTHTHTHTHTHTHTHTRL

SEQ ID NO: 758925 - protein, 781 aa, Homo sapiens
MPGCCRYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 758926 - protein, 429 aa, Homo sapiens
VGGGEEEGGVCMHVKRGCMSATTCPLVPAASGSDGLRTPQHHIHPLPEFSLSGGAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 758927 - protein, 775 aa, Homo sapiens
MPGCCRYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKSVKCLKCQEQKRAVLPCQHAALCELCAEGSECPICQPGRAHTLQS

SEQ ID NO: 758928 - protein, 781 aa, Homo sapiens; identical to SEQ ID NO: 758925

SEQ ID NO: 758929 - protein, 783 aa, Homo sapiens
MPGCCRYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPMLPLGLSTKGLSMN

SEQ ID NO: 758930 - protein, 836 aa, Homo sapiens
GALGPRRGPRRLNNKRGAAKRQEDKTMSKGPGPGGSAASSAPPAATAQVLQAQPEKPQHYTYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 758931 - protein, 781 aa, Homo sapiens; identical to SEQ ID NO: 758925

SEQ ID NO: 758932 - protein, 569 aa, Homo sapiens
EVGPRGEVGPRGGAGNTGQEMTKPAHSCWRKGSLPGLPSGLSLTCLCSALQIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 758933 - protein, 781 aa, Homo sapiens; identical to SEQ ID NO: 758925

SEQ ID NO: 758934 - protein, 70 aa, Homo sapiens
LVDQEKQCRRLIFDGSDYNGLRYEAGWRLPYSLPGQGWSVEDVGPPEQAWPPAVRASGRPEGECWGSQLA

SEQ ID NO: 758935 - protein, 69 aa, Homo sapiens
PPYAGLPLLLLFPLSLQDMLGILPAGSPLTSSISSSITSSLAATPPSPVGTSSVPGMNANALPFYPTSD

SEQ ID NO: 758936 - protein, 133 aa, Homo sapiens
AEIVFANRKCGTPATEALESVMEAYEQVQKGPLKLKGVAELGVTKRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 758937 - protein, 168 aa, Homo sapiens
GNSVCKQEVWHSSYRSTGECHGGLRAGPKGTPEAERRRRAGSDQAVRPEGPRDSVFIPLRPFLGTPGPDPPTRRLLMSFSRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 758938 - protein, 143 aa, Homo sapiens
VLELVNPPAAGIRQESARRAGPKGTPEAERRRRAGSDQAEEEKEGQRQSETPGSNGNEQKERGGEAARPGQADPGPGGLRENAGEAEMRFHHVGQADLELLISSDPPASASQSAGITGVSHRTQSQLLILNGHAHDDFVCIVL

SEQ ID NO: 758939 - protein, 133 aa, Homo sapiens; identical to SEQ ID NO: 758936

SEQ ID NO: 758940 - protein, 168 aa, Homo sapiens; identical to SEQ ID NO: 758937

SEQ ID NO: 758941 - protein, 133 aa, Homo sapiens; identical to SEQ ID NO: 758936

SEQ ID NO: 758942 - protein, 128 aa, Homo sapiens
AEIVFANRKCGTPATEALESVMEAYEQVQKGPLKLKGVAELGVTKRKKKKKDKDKAKLLEAMGTSKKNEEEKRRGLDKRTPAQAAFEKMQEKRQGHQTSCTATGFQGHKANAARSYAWTQNWYCVPSS

SEQ ID NO: 758943 - protein, 71 aa, Homo sapiens
DSRSVDSRGSQTPEGKELAPWWPAVCRAPQDPAWAPFQASSSFGPMLSPAGPREATCNYAAFRLPPQPPGH

SEQ ID NO: 758944 - protein, 116 aa, Homo sapiens
GEVMLALTQRSPALGQRRTNAPNPTPFSGPFTLSTCKCSCLVTLGTPIRQRPVPPAPVDRFSMLGLWRLYSCRASLPPPFQVLLMGVAIADAANASQHSLKWNQTQPASQSSAGGS

SEQ ID NO: 758945 - protein, 312 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 758946 - protein, 144 aa, Homo sapiens
FTGEPPGNKGFPTLCGSPFLKFPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 758947 - protein, 117 aa, Homo sapiens
RQSLTLPPRLEHSGMIFAHCNLCLLGSSDSHTSASRVAGITGVHHHIQLIFVVLAVMGFHHVGQAGLELLASSDPPISASQSVGITGVSHCAQSTLGILNPILKISNGGTKKQPAHN

SEQ ID NO: 758948 - protein, 100 aa, Homo sapiens
VALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 758949 - protein, 437 aa, Homo sapiens
MSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKAGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 758950 - protein, 109 aa, Homo sapiens
FIFFFIEMLPSFLQKVEVVSEASRETCVALTDCLNLFTKQEGVRNFKLEQEQEKNKILSEALETLATEHHELEQSLVKGSPPASILSEDEFYDALSGNSGILPSALLVI

SEQ ID NO: 758951 - protein, 558 aa, Homo sapiens
MLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKAGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 758952 - protein, 775 aa, Homo sapiens
GNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKAGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 758953 - protein, 146 aa, Homo sapiens
MLLWCPPQCACSLGVFPSAPSPVWGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 758954 - protein, 146 aa, Homo sapiens; identical to SEQ ID NO: 758953

SEQ ID NO: 758955 - protein, 160 aa, Homo sapiens
MRCHAHGPSCLVTAITREEGGPRSGGAQAKLGCCWGYPSPRSTWNPDRRFWTPQTGPGEGRHERHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 758956 - protein, 146 aa, Homo sapiens; identical to SEQ ID NO: 758953

SEQ ID NO: 758957 - protein, 146 aa, Homo sapiens; identical to SEQ ID NO: 758953

SEQ ID NO: 758958 - protein, 105 aa, Homo sapiens
EILQQKVAGVQRELEDFKKEALKSIHYLEDAFCEMNGALVQQEEQAARVRQRLREEEDRGIVRNKVLTFLLPREKQLREHCKRLEDLLLDRGRDALRATKKSQAD

SEQ ID NO: 758959 - protein, 111 aa, Homo sapiens
ICKPLLYPAIMTNGLCIRYCYVGGLLHALIHEGFLFRLTFCNSNVVHHIYCDIIPLSKISCTDSSINFLMVFIFSGSIQVFTIGTGLISYTFVLFTILKKKSVKGIRKAFS

SEQ ID NO: 758960 - protein, 323 aa, Homo sapiens
DSREHHPLQTGVSGNRPKMLGRNTWKTSAFSFLVEQMWAPLWSRSMRPGRWCSQRSCAWQTSNNTLHPLWTVPVSVPGGTRQSPINIQWRDSVYDPQLKPLRVSYEAASCLYIWNTGYLFQVEFDDATEASGISGGPLENHYRLKQFHFHWGAVNEGGSEHTVDGHAYPAELHLVHWNSVKYQNYKEAVVGENGLAVIGVFLKLGAHHQTLQRLVDILPEIKHKDARAAMRPFDPSTLLPTCWDYWTYAGSLTTPPLTESVTWIIQKEPVEVAPSQLSAFRTLLFSALGEEEKMMVNNYRPLQPLMNRKVWASFQATNEGTRS

SEQ ID NO: 758961 - protein, 122 aa, Homo sapiens
MPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 758962 - protein, 152 aa, Homo sapiens
MTHCGHLGSLGHPCWLCSILVPRHWNALVSRNEVQAHGCDVTEHVKSEVLWKVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 758963 - protein, 122 aa, Homo sapiens; identical to SEQ ID NO: 758961

SEQ ID NO: 758964 - protein, 64 aa, Homo sapiens
RRVFCTNKTIVLTNSHGQWQSDGPGPWMTPLQEHLQGSREVTGATYWKLAGPEDRPAPHALAQG

SEQ ID NO: 758965 - protein, 191 aa, Homo sapiens [sequence omitted]

SEQ ID NO: 758966 - protein, 191 aa, Homo sapiens [sequence omitted]

SEQ ID NO: 758967 - protein, 191 aa, Homo sapiens [sequence omitted]

SEQ ID NO: 758968 - protein, 287 aa, Homo sapiens
MDMAWQMMQLLLLALVTAAGSAQPRSARARTDLLNVCMNAKHHKTQPSPEDELYGQVGAPQGPSPGSVPLDDLPGAEEPEYGGDGCGGERLSPVSSPPSAVPGRRMPAARPAPARSCTRTPPACTTLTGITVVRWNPPASATLSRTAVSECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 758969 - protein, 135 aa, Homo sapiens
GWWTPCPLPQLWSPSRVKLLRYVADRSILSPPHSGQPELAQRAAGGRTVAPPTPAKATGTKAGIGPQGLMSVRPGPSAAPLSPTSPLQPPFVKASGATPSRSATIVEGAAAASRCGLTQPRATPMRRWPSSMLRP

SEQ ID NO: 758970 - protein, 199 aa, Homo sapiens [sequence omitted]

SEQ ID NO: 758971 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 758972 - protein, 326 aa, Homo sapiens; identical to SEQ ID NO: 758971

SEQ ID NO: 758973 - protein, 326 aa, Homo sapiens; identical to SEQ ID NO: 758971

SEQ ID NO: 758974 - protein, 326 aa, Homo sapiens; identical to SEQ ID NO: 758971

SEQ ID NO: 758975 - protein, 326 aa, Homo sapiens; identical to SEQ ID NO: 758971

SEQ ID NO: 758976 - protein, 326 aa, Homo sapiens; identical to SEQ ID NO: 758971

SEQ ID NO: 758977 - protein, 287 aa, Homo sapiens
MPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 758978 - protein, 341 aa, Homo sapiens
CRLYPSPPSAAPTRRSPGEGGGRGAGEIERQKALCWEGPILLHRVGRPKKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 758979 - protein, 287 aa, Homo sapiens; identical to SEQ ID NO: 758977

SEQ ID NO: 758980 - protein, 326 aa, Homo sapiens; identical to SEQ ID NO: 758971

SEQ ID NO: 758981 - protein, 122 aa, Homo sapiens
MSVGLDLPQMLPGSPSPSLKEAFAEDGEAGEGGGRPSLEWRLQQLLPQHPLSLSWLLTSPQGTGPFLPSVVICHLLDQVLSLLHSPVPTPVHSSGPGSKQAVNSWPELSLWLVAHAPFLVVC

SEQ ID NO: 758982 - protein, 326 aa, Homo sapiens; identical to SEQ ID NO: 758971

SEQ ID NO: 758983 - protein, 326 aa, Homo sapiens; identical to SEQ ID NO: 758971

SEQ ID NO: 758984 - protein, 326 aa, Homo sapiens; identical to SEQ ID NO: 758971

SEQ ID NO: 758985 - protein, 326 aa, Homo sapiens; identical to SEQ ID NO: 758971

SEQ ID NO: 758986 - protein, 326 aa, Homo sapiens; identical to SEQ ID NO: 758971

SEQ ID NO: 758987 - protein, 326 aa, Homo sapiens; identical to SEQ ID NO: 758971

SEQ ID NO: 758988 - protein, 99 aa, Homo sapiens
ISGALAIHTERLNWKSLGFLMACPPSSLSHTHTHPCSRITRHLHGSSYGNSCIGAAFLFGLGTSVLLVAPLARQLGGVDSDWAAGSSGTAQGGRSDQLV

SEQ ID NO: 758989 - protein, 326 aa, Homo sapiens; identical to SEQ ID NO: 758971

SEQ ID NO: 758990 - protein, 159 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAVRNSA

SEQ ID NO: 758991 - protein, 241 aa, Homo sapiens
RPRRYRELLGFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKCDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 758992 - protein, 372 aa, Homo sapiens
MNHCQLPVVIDNGSGMIKAGVAGCREPQFIYPNIIGRAKGQSRAAQGGLELCVGDQAQDWRSSLFISYPVERGLITSWEDMEIMWKHIYDYNLKLKPCDGPVLITEPALNPLANRQQITEMFFEHLGVPAFYMSIQAVLALFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKCDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 758993 - protein, 229 aa, Homo sapiens
ASRILRKSKDSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKCDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 758994 - protein, 314 aa, Homo sapiens
CGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECGKAFTCSTELVRHQKVHTGERPHKCKECGKAFIRRSELTHHERSHTGEKPYECKECGKPLVVAQNLVDTRKFILVRNHMNVSSVERPSFGPHTLVNIKEFIQDRGVNEEMRDGSEFD

SEQ ID NO: 758995 - protein, 686 aa, Homo sapiens
APAAGAPGRPGPASAGTAAGRMLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 758996 - protein, 686 aa, Homo sapiens; identical to SEQ ID NO: 758995

SEQ ID NO: 758997 - protein, 187 aa, Homo sapiens
APAAGAPGRPGPASAGTAAGRMLRERTVRLQYGSRVEAVYVLGTYLWTDVYSEPAHRDARAEISSPEILRRAQTRGRGQPLSSPSCPSSRAPEPRNPKNLIQKPDNPRTLCPPSRNPETLPDPLTQPQPQLPHRPSLSPVTLRLALSSSPPGGPHTPSASLPSSPLSLPLRTSLPLGPTSTQPLSCF

SEQ ID NO: 758998 - protein, 123 aa, Homo sapiens
SGFDLPKCWKQESPLEAPHPTYPRALPEPSLISPHSAAPAGAQTFSLKHSEHVWVEVVRDGEAEEVATNGKQRWLLSPSTTLRVTMSQASTEASSDKVPRREVQPLRARDHARIEAGWTSPVP

SEQ ID NO: 758999 - protein, 89 aa, Homo sapiens
PRGALGPDTDLATFPRKPQSSANSQPSKTQLQSSQPRKVLQLSAVASLFSVSMPSRMKKISSKVSYYFYQETTIGIPQTAPLAVHNACS

SEQ ID NO: 759000 - protein, 375 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759001 - protein, 320 aa, Homo sapiens
MNTHQCQRVQGKCKWPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759002 - protein, 390 aa, Homo sapiens
MGLLVFVRNLLLALCLFLVLGFLYYSAWKLHLLQWEEDSSKYSHSSSPQEKPVADSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759003 - protein, 386 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVSAQALSGPALCRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759004 - protein, 433 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRAKRNGAWRQKHIQAYVLRQRRRQRIVGTQRRPFSWRSDERLTGETSWGSLMPELCWERFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759005 - protein, 384 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKEVSTVTEYWRVVTKKAPSPGRGSKGLSKGPTDHFISPFSPGRTISSERKSFCGSW

SEQ ID NO: 759006 - protein, 155 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 759007 - protein, 375 aa, Homo sapiens; identical to SEQ ID NO: 759000

SEQ ID NO: 759008 - protein, 359 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759009 - protein, 375 aa, Homo sapiens; identical to SEQ ID NO: 759000

SEQ ID NO: 759010 - protein, 281 aa, Homo sapiens [sequence omitted]

SEQ ID NO: 759011 - protein, 395 aa, Homo sapiens
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFEDEAILFLSKQCTYKQRLRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759012 - protein, 220 aa, Homo sapiens
SIPHPVPARRLPSYPPLLHTGAPPHALFTIIPLVPVTHSISPNTDGLPTPQALGSPLNASCSRLTVPTWGPCHSPRLIPCCVPRGGPLLLCPQSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 759013 - protein, 246 aa, Homo sapiens
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVLFPKQGQVQAVSSR

SEQ ID NO: 759014 - protein, 916 aa, Homo sapiens
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 759015 - protein, 106 aa, Homo sapiens
MPCAPRAQRREAVGVLVAPPRVPPRTPRRGSLGAAVFSSSDLTFDAEAQGQVRRPRPAQAVGPSGARRPEAPGWFRKSDRSGRAGTGAWSQWPQANPDEQQPQVAY

SEQ ID NO: 759016 - protein, 73 aa, Homo sapiens
AGWYGRSLGYFDAEAQGQVRRPRPAQAVGPSGARRPEAPGWFRKSDRSGRAGTGAWSQWPQANPDEQQPQVAY

SEQ ID NO: 759017 - protein, 106 aa, Homo sapiens; identical to SEQ ID NO: 759015

SEQ ID NO: 759018 - protein, 106 aa, Homo sapiens; identical to SEQ ID NO: 759015

SEQ ID NO: 759019 - protein, 106 aa, Homo sapiens; identical to SEQ ID NO: 759015

SEQ ID NO: 759020 - protein, 470 aa, Homo sapiens
GRLGFPEGPEGGRGRHVRAARGPVGPRAGEGPCAAWVGVGPGSAPGTSLREGPGAGAPQRPAGGRASGRAARSRPEARAEGAPSPVVGAPPAGSAGWAAPGPAMSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 759021 - protein, 444 aa, Homo sapiens
AAGGAGGACAGCPAFPLSGPPRSSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRVSPGGEAAHQPSPSAIPPPPRPTCEDVMGSGCCATPYAQPLVGTCLGAQVPWSALEGLQRARGPGPVAPSLGATQALGCAHAWEGGAQWPPFLCPQDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 759022 - protein, 289 aa, Homo sapiens
LARKPRGTGKGVEKVTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 759023 - protein, 579 aa, Homo sapiens
GRLGFPEGPEGGRGRHVRAARGPVGPRAGEGPCAAWVGVGPGSAPGTSLREGPGAGAPQRPAGGRASGRAARSRPEARAEGAPSPVVGAPPAGSAGWAAPGPAMSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKREWGAPGTACVDPSGGLWAGPVWTCELGAPGGPVWTRELGAPGRACVDPVGPVQVARLRVLDPHPWDAGQVRRMGGQGSMGPCGLVEMTSGWSWKLKGRVFLAGSAQRLAQKEPGVVKGSCESGNQGPLSPSWPP

SEQ ID NO: 759024 - protein, 470 aa, Homo sapiens; identical to SEQ ID NO: 759020

SEQ ID NO: 759025 - protein, 186 aa, Homo sapiens
MTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 759026 - protein, 446 aa, Homo sapiens
GRLGFPEGPEGGRGRHVRAARGPVGPRAGEGPCAAWVGVGPGSAPGTSLREGPGAGAPQRPAGGRASGRAARSRPEARAEGAPSPVVGAPPAGSAGWAAPGPAMSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTDLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 759027 - protein, 315 aa, Homo sapiens
MRTCVLLSAVLWCLTGDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 759028 - protein, 315 aa, Homo sapiens; identical to SEQ ID NO: 759027

SEQ ID NO: 759029 - protein, 219 aa, Homo sapiens
MRTCVLLSAVLWCLTGAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 759030 - protein, 337 aa, Homo sapiens
MRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 759031 - protein, 66 aa, Homo sapiens
GNSINPCFSNPDRPHWLELPPSSPAPARSLQASATTCCYGKHTDNRLGQTWQRYGLSAIFSPCLRE

SEQ ID NO: 759032 - protein, 69 aa, Homo sapiens
RSLPASGSRAQPPVHAPCSASFALQCASRDDWRCARSMHEFSAKDIDGHMVNLDKYRGFVCIVTNVASQ

SEQ ID NO: 759033 - protein, 107 aa, Homo sapiens
ALWRAWPWERRRGKPTRVHWSAGRGEEPLAPSPAAMSLGRLCRLLKPALLCGALAAPGLAGTMCASRDDWRCARSMHEFSAKDIDGHMVNLDKYRGFVCIVTNVASQ

SEQ ID NO: 759034 - protein, 107 aa, Homo sapiens; identical to SEQ ID NO: 759033

SEQ ID NO: 759035 - protein, 107 aa, Homo sapiens; identical to SEQ ID NO: 759033

SEQ ID NO: 759036 - protein, 109 aa, Homo sapiens
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKYRGFVCIVTNVASQ

SEQ ID NO: 759037 - protein, 125 aa, Homo sapiens
PWFNLVTSDRPPRPPPPTPSPANHRTPRDSLVDLHARYAECGLRILAFPCNQFGKQEPGSNEEIKEFRRGLQRQIRYVQQDLRERGRRPPAVEVDEDPNPRARASWEMPSSGTSPSSSSTRTAAW

SEQ ID NO: 759038 - protein, 364 aa, Homo sapiens
MFSKICVNGDDAHPLWKWMKIPTQGQGHPGKCHQVELHQVPHRQERLRGEALRTHGGAPGDREGPAPLFLAPQVLWPRPSPCPRPWSLPPALMTACLQTCWWGRPENPACTPPEEGPMACWAWLGAPTPGYLVGINRQISLLEHTPQKGTNRTKRYPRSGAQHTPDNPHNRGTHVHHTSEQHQHTKNWAEEKKQQKMQKIGTHAETTRNTHHQPPGRTHNTRTKAHTTDQYTAQNGTPTHPNEAHTACTATHTTHTPTKHGTKRNKTHTHNYTTSNNTPQDTETKHKKDNKQKQKPRKKNKRRAHYTGRSTEDTQSTKATNNNKNHRPPHEKEERRKDRQKGKRENTTSLSPLRIKTRRRTRPD

SEQ ID NO: 759039 - protein, 150 aa, Homo sapiens
MFSKICVNGDDAHPLWKWMKIPTQGQGHPGKCHQVELHQVPHRQERLRGEALRTHGGAPGDREGPAPLFLAPQVLWPRPQPWVVGAPAEDQDSTWTSHSLSHRYHEGLRGSPRCHPHCYCPLRSRICLPIFLGHQTLLLCLHCPPTARAH

SEQ ID NO: 759040 - protein, 107 aa, Homo sapiens; identical to SEQ ID NO: 759033

SEQ ID NO: 759041 - protein, 107 aa, Homo sapiens; identical to SEQ ID NO: 759033

SEQ ID NO: 759042 - protein, 107 aa, Homo sapiens; identical to SEQ ID NO: 759033

SEQ ID NO: 759043 - protein, 107 aa, Homo sapiens; identical to SEQ ID NO: 759033

SEQ ID NO: 759044 - protein, 134 aa, Homo sapiens
MFSKICVNGDDAHPLWKWMKIPTQGQGHPGKCHQVELHQVPHRQERLRGEALRTHGGAPGDREGPAPLFLAPQVLWPRPSPCPRPWSLPPALMTACLQTCWWGRPENPACTPPEEGPMACWAWSGPTWYCGITT

SEQ ID NO: 759045 - protein, 113 aa, Homo sapiens
GSVQGARTEGVPAPDSLTHLGRHRSQGVTKRSKSFAAGYNVKFDMFSKICVNGDDAHPLWKWMKIPTQGQGHPGKDSLGTVGGCWGRSRPCASFPVPSSGTSPSSSSTRTAAW

SEQ ID NO: 759046 - protein, 399 aa, Homo sapiens
RDAWVDPRVRRTRWVSQGVTKRSKSFAAGYNVKFDMFSKICVNGDDAHPLWKWMKIPTQGQGHPGKCHQVELHQVPHRQERLRGEALRTHGGAPGDREGPAPLFLAPQVLWPRPSPCPRPWSLPPALMTACLQTCWWGRPENPACTPPEEGPMACWAWLGAPTPGYLVGINRQISLLEHTPQKGTNRTKRYPRSGAQHTPDNPHNRGTHVHHTSEQHQHTKNWAEEKKQQKMQKIGTHAETTRNTHHQPPGRTHNTRTKAHTTDQYTAQNGTPTHPNEAHTACTATHTTHTPTKHGTKRNKTHTHNYTTSNNTPQDTETKHKKDNKQKQKPRKKNKRRAHYTGRSTEDTQSTKATNNNKNHRPPHEKEERRKDRQKGKRENTTSLSPLRIKTRRRTRPD

SEQ ID NO: 759047 - protein, 147 aa, Homo sapiens
MFSKICVNGDDAHPLWKWMKIPTQGQGHPGKCHQVELHQVPHRQERLRGEALRTHGGAPGDREGPAPLFLAPQVLWPRPSPCPRPWSLPPALMTACLQTCWWGRPENPACTPPEEGPMACWAWLGAPTPGYLVGINRQISLLEKIKK

SEQ ID NO: 759048 - protein, 107 aa, Homo sapiens; identical to SEQ ID NO: 759033

SEQ ID NO: 759049 - protein, 106 aa, Homo sapiens
MARGPVGGCWDSHTAWPPGVRWLWGGLGALWLWRQPGKLTPCGLLETGQLGDCGGLLGTLTSMCFFSSAIKWNFTKFLIDKNGCVVKRYGPMEEPLVIEKDLPHYF

SEQ ID NO: 759050 - protein, 107 aa, Homo sapiens; identical to SEQ ID NO: 759033

SEQ ID NO: 759051 - protein, 107 aa, Homo sapiens; identical to SEQ ID NO: 759033

SEQ ID NO: 759052 - protein, 337 aa, Homo sapiens
ARYEAWCWKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAGGLGGFLSSWVPRAAPWAALGPPQGALPGVPGPDLACC

SEQ ID NO: 759053 - protein, 680 aa, Homo sapiens
MGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759054 - protein, 673 aa, Homo sapiens
GWYRSGEFGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759055 - protein, 680 aa, Homo sapiens; identical to SEQ ID NO: 759053

SEQ ID NO: 759056 - protein, 680 aa, Homo sapiens; identical to SEQ ID NO: 759053

SEQ ID NO: 759057 - protein, 654 aa, Homo sapiens
MGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSLPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759058 - protein, 640 aa, Homo sapiens
KGMGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759059 - protein, 432 aa, Homo sapiens
KGMGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPDTEGWLGDILPQCVSG

SEQ ID NO: 759060 - protein, 663 aa, Homo sapiens
MAFDSYCALVLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759061 - protein, 596 aa, Homo sapiens
KGMGQGSHLMLVPLVAGGKNTMDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759062 - protein, 625 aa, Homo sapiens
DAWVDPRVRGKNTMDLVLKRCLLHLAVIGALLAVGATKVPRNQDWLGVSRQLRTKAWNRQLYPEWTEAQRLDCWRGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759063 - protein, 523 aa, Homo sapiens
SGRTSCVVKKLVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759064 - protein, 206 aa, Homo sapiens
GRVGRPTRPRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759065 - protein, 189 aa, Homo sapiens
QPIASRGRVVNRPRLDIAQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759066 - protein, 205 aa, Homo sapiens
DAWVDPRVRGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGEGLPSQPIIHTCVYFFLPDHLSFGRPFHLNFCDFL

SEQ ID NO: 759067 - protein, 206 aa, Homo sapiens; identical to SEQ ID NO: 759064

SEQ ID NO: 759068 - protein, 674 aa, Homo sapiens
DAWVDPRVRGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759069 - protein, 680 aa, Homo sapiens; identical to SEQ ID NO: 759053

SEQ ID NO: 759070 - protein, 687 aa, Homo sapiens
MGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 759071 - protein, 537 aa, Homo sapiens
KGMGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVHGIESSEILQAIPSCYVNVFIIICSI

SEQ ID NO: 759072 - protein, 440 aa, Homo sapiens
MGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPPLDLAMR

SEQ ID NO: 759073 - protein, 347 aa, Homo sapiens
KGMGQGSHLMLVPLVAGGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAGGLGGFLSSWVPRAAPWAALGPPQGALPGVPGPDLACC

SEQ ID NO: 759074 - protein, 478 aa, Homo sapiens
MEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759075 - protein, 620 aa, Homo sapiens
DAWVDPRVRGKNTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 759076 - protein, 273 aa, Homo sapiens
SGRTSCVVKKLVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPDTEGWLGDILPQCVSG

SEQ ID NO: 759077 - protein, 90 aa, Homo sapiens
LCAWSETENLEPDLPASDSLLLGVRLKTGSRLPCLLQARRTYPFSACAPPCACALPASRRRALQPLRDSAAHSPRMVFPPEFFPGRGSQD

SEQ ID NO: 759078 - protein, 90 aa, Homo sapiens; identical to SEQ ID NO: 759077

SEQ ID NO: 759079 - protein, 90 aa, Homo sapiens; identical to SEQ ID NO: 759077

SEQ ID NO: 759080 - protein, 375 aa, Homo sapiens
PRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSLSSDYTVS

SEQ ID NO: 759081 - protein, 94 aa, Homo sapiens
LYDDLRCDPERDHFRKICEEYITGKFDPQDIETKNLDLILNYFLLSTLLTLCLVFLYEGFTAEIDVCSLPSSLPKPGPAHTHWTVPVLTAASLL

SEQ ID NO: 759082 - protein, 488 aa, Homo sapiens
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 759083 - protein, 301 aa, Homo sapiens
TGSLLTSLNKNLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 759084 - protein, 160 aa, Homo sapiens [sequence omitted]

SEQ ID NO: 759085 - protein, 338 aa, Homo sapiens
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVRQFWLQRTAPSGGQQRTA

SEQ ID NO: 759086 - protein, 128 aa, Homo sapiens
AAARPLGRGAAGGGVGARVCECVRAVAPPPPAPRSVPLARPGRAALSRVRALFPPPPPPPFCELVSVTGARVTACPSGTDSVGGRRRRSRSGRSSWDRDGARAPGSPDPRSPARGGGLACQLGNGRLS

SEQ ID NO: 759087 - protein, 91 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMG

SEQ ID NO: 759088 - protein, 64 aa, Homo sapiens
MEQQTISVAKAGLVCKLNTRTTILAATNPKGQYDPQESVSVNIALGSPLLSRFDLILVLLDTKN

SEQ ID NO: 759089 - protein, 789 aa, Homo sapiens
METLLGGLLAFGMAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTMILVIGGIIVATLLVFIVILMVRYKVCNHEAPSKMAAAVSNVYSQTNGAQPPPPSSAPAGAPPQGPPKVVVRNELLDFTASLARASDSSSSSSLGSGEAAGLGRAPWRIPPSAPRPKPSLDRLMGAFASLDLKSQRKEELLDSRTPAGRGAGTSARGHHSDREPLLGPPAARARSLLPLPLEGKAKRSHSFDMGDFAAAAAGGVVPGGYSPPRKVSNIWTKRSLSVNGMLLPFEESDLVGARGTFGSSEWVMESTV

SEQ ID NO: 759090 - protein, 148 aa, Homo sapiens
MFLELDVSPPAVFEMEFSHDQEQDPRALHMERLMRLDSFLERPSTSKVRKSRSWCHRIFFLSMLPTPIPQACMPKPPLIPLITSLLSSLISHLPLFASLPHPHFLPLCVNPSLFSVIDSISIPKTTLCLSVSLSLRVPQPGLMGSSES

SEQ ID NO: 759091 - protein, 793 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 759092 - protein, 458 aa, Homo sapiens
MIPQLGGRTPGEPLPSGGPGPPAAHDRQPTLWIPRGRRRRQLAAHPHPIFLFLYLIVAEAVYGSAPSAPAWGGLRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 759093 - protein, 789 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRLSLRWNSLTTKNKTLVRYTWRGSCDWTAFWKDLPRLKSESPDPGARVLSGLHLPPHMPPWPLLLCALQQWRTMSDNHHVRLPIQ

SEQ ID NO: 759094 - protein, 793 aa, Homo sapiens; identical to SEQ ID NO: 759091

SEQ ID NO: 759095 - protein, 672 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVYFM

SEQ ID NO: 759096 - protein, 857 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCHRIFSSAMLPTPIPQACMPKPPLIPLITSLLSSLISHLPLFASLPHPHFLPLCVNPSLFSVIDSISIPKTTLCLSVSLSLRVPQPGLMGSSES

SEQ ID NO: 759097 - protein, 616 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLRGCAVNQESRALASAAGAGSAAVGFRWALGGKGPDQQTS

SEQ ID NO: 759098 - protein, 793 aa, Homo sapiens; identical to SEQ ID NO: 759091

SEQ ID NO: 759099 - protein, 535 aa, Homo sapiens
MIPQLGGRTPGEPLPSGGPGPPAAHDRQPTLWIPRGRRRRQLAAHPHPIFLFLYLIVAEAVYGSAPLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 759100 - protein, 669 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGV

SEQ ID NO: 759101 - protein, 169 aa, Homo sapiens
TGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 759102 - protein, 145 aa, Homo sapiens
KAKNSPVPAMSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 759103 - protein, 145 aa, Homo sapiens; identical to SEQ ID NO: 759102

SEQ ID NO: 759104 - protein, 90 aa, Homo sapiens
GFGRFGQLLYCILFYLRSLLNSYLTAFASEYSRCQQGFELFALSSIFFLSPQDSLYSHLGFSKRILHGEFQMMFSDKFVPQTTWDSEEYF

SEQ ID NO: 759105 - protein, 69 aa, Homo sapiens
KRFRPQPAHLAEEEPRDALSGIGFSQQSLEGLAARRAQRALLCLFGACGLREREDREARRLLPFWRLPH

SEQ ID NO: 759106 - protein, 69 aa, Homo sapiens; identical to SEQ ID NO: 759105

SEQ ID NO: 759107 - protein, 69 aa, Homo sapiens; identical to SEQ ID NO: 759105

SEQ ID NO: 759108 - protein, 124 aa, Homo sapiens
NEFSSNLWNEEQAYIIVYLCMVCNFKNFNDSKINKAVYISWKIRQQYFSFPVAVITVQPSDAPLRHSARKKFPSLGHPASCLSPAVFYQIGEHSHSGLEIKFYKNPMPQPELQWCSTFPAPRTY

SEQ ID NO: 759109 - protein, 332 aa, Homo sapiens
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDVIF

SEQ ID NO: 759110 - protein, 332 aa, Homo sapiens; identical to SEQ ID NO: 759109

SEQ ID NO: 759111 - protein, 216 aa, Homo sapiens
MKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDVIF

SEQ ID NO: 759112 - protein, 696 aa, Homo sapiens
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 759113 - protein, 1358 aa, Homo sapiens
PGLSRHQSLNPGLCKRHLIPGSRALPALHPLPNLPRLPRSLPRSLPARFLPHHRSARRKGPGLKMALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 759114 - protein, 1358 aa, Homo sapiens; identical to SEQ ID NO: 759113

SEQ ID NO: 759115 - protein, 1358 aa, Homo sapiens; identical to SEQ ID NO: 759113

SEQ ID NO: 759116 - protein, 1280 aa, Homo sapiens
PGLSRHQSLNPGLCKRHLIPGSRALPALHPLPNLPRLPRSLPRSLPARFLPHHRSARRKGPGLKMALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPR

SEQ ID NO: 759117 - protein, 1168 aa, Homo sapiens
PGLSRHQSLNPGLCKRHLIPGSRALPALHPLPNLPRLPRSLPRSLPARFLPHHRSARRKGPGLKMALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQK

SEQ ID NO: 759118 - protein, 151 aa, Homo sapiens
MTSSQSGPILNIETPKNSRQLLQTQQVIGPERGGDPRPQERERGQRWFPAPRTIMALPLRPLTRGLASAAKGGHGGAGARTWRLLTFVLALPSVALCTFNSYLHSGHRPRPEFRPYQHLRIRTKPYPWGDGNHTLFHNSHVNPLPTGYEHP

SEQ ID NO: 759119 - protein, 131 aa, Homo sapiens
MALPLRPLTRGLASAAKGGHGGAGGEWGTGGSGGSPTLPTCSQARRPRTAALTPLLSAARTWRLLTFVLALPSVALCTFNSYLHSGHRPRPEFRPYQHLRIRTKPYPWGDGNHTLFHNSHVNPLPTGYEHP

SEQ ID NO: 759120 - protein, 90 aa, Homo sapiens
PLTRGLRGKAMMVRGAGARTWRLLTFVLALPSVALCTFNSYLHSGHRPRPEFRPYQHLRIRTKPYPWGDGNHTLFHNSHVNPLPTGYEHP

SEQ ID NO: 759121 - protein, 592 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 759122 - protein, 592 aa, Homo sapiens; identical to SEQ ID NO: 759121

SEQ ID NO: 759123 - protein, 557 aa, Homo sapiens
MLFIFVVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 759124 - protein, 479 aa, Homo sapiens
PSPNATYQLQEPPSGITSQAVTDPTAGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 759125 - protein, 185 aa, Homo sapiens
PSPNATYQLQEPPSGITSQAVTDPTAGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAVKTEPMSSSETASTTADCHLQGV

SEQ ID NO: 759126 - protein, 379 aa, Homo sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEERQKKRKREKKELKLENHQENSRNQKPKKRKKGQEADLEAGGEEVPEANGSAGKRSKKKKQRKDSASEEEARVGAGKRKRRHSEVETDSKKKKMKLPEHPEGGEPEDDEAPAKGKFNWKGTIKAILKQAPDNEITIKKLRKKVLAQYYTVTDEHHRSEEELLVIFNKKISKNPTFKLLKDKVKLVK

SEQ ID NO: 759127 - protein, 82 aa, Homo sapiens
GGARAAGSFFPQSVKPGGDFKHSETGPNMKKPSKTKEKVLAQYYTVTDEHHRSEEELLVIFNKKISKNPTFKLLKDKVKLVK

SEQ ID NO: 759128 - protein, 379 aa, Homo sapiens; identical to SEQ ID NO: 759126

SEQ ID NO: 759129 - protein, 260 aa, Homo sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEERQKKRKREKKELKLENHQENSRNQKPKKRKKGQEADLEAGGEEVPEANGSAGKRSKKKKQRKDSSQ

SEQ ID NO: 759130 - protein, 212 aa, Homo sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEECARKPLPIPHWCGVRRTR

SEQ ID NO: 759131 - protein, 97 aa, Homo sapiens
QKLFLYPSRSTTKRNVLNIIIYIVGKFNWKGTIKAILKQAPDNEITIKKLRKKVLAQYYTVTDEHHRSEEELLVIFNKKISKNPTFKLLKDKVKLVK

SEQ ID NO: 759132 - protein, 111 aa, Homo sapiens
AVLPFFLFYSSSPPLAVPRRLSLWRLEPWWRFLHVKCISEDQKYGGKGYEGKTHKGDIKQQAWIQKISELIKRPNVSPKVRELLEQIRSLLFFFTSPCCSTASFTLEAGTL

SEQ ID NO: 759133 - protein, 379 aa, Homo sapiens; identical to SEQ ID NO: 759126

SEQ ID NO: 759134 - protein, 167 aa, Homo sapiens
MVFFTCNACGESVKKIQVEKHVSVCRNCECLSCIDCGKDFWGDDYKNHVKCIVLFLISPSSSQTFKAPRKAQSLGSSTVEMAANVVLTSRFLNLELKSFVTDPTSCPNVFPIIFLYGPCSSQPLILELGTGSATSMLLSCCSPAWNVNYLANSYCSSVTLQGGRAGL

SEQ ID NO: 759135 - protein, 132 aa, Homo sapiens
YFSSKMSENCDQVVWTGYYGLVYNLVKISWELQGDEEQDGLRNMIWQTLQKTKDYEEDVRIQNAINIAQAELNDPTDPFTRYSTNISSNVGEEVFSKYIGWRIANTLSKLFFPPIEAHFLPLKKPSIKKDQT

SEQ ID NO: 759136 - protein, 75 aa, Homo sapiens
VFTLNHPLTIASVDKQVGPYPGLPMPLGLCWPYADGDFFKNRNEIHVSSCSTIENNDGETLPAPNWNLKHGNSSV

SEQ ID NO: 759137 - protein, 120 aa, Homo sapiens
MALISPKSILLWPLHPCWHSLAYHSYNLILSLTPPSSIIPPSLTQGIVWGRGIAAQSRRQVHIQGLTSPFFENYWLGPISKDFLCPAVFMRLLSVHAIVTAFLFLHSSSLPSSLEPSAST

SEQ ID NO: 759138 - protein, 114 aa, Homo sapiens [sequence omitted]

SEQ ID NO: 759139 - protein, 702 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEVLRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 759140 - protein, 702 aa, Homo sapiens; identical to SEQ ID NO: 759139

SEQ ID NO: 759141 - protein, 702 aa, Homo sapiens; identical to SEQ ID NO: 759139

SEQ ID NO: 759142 - protein, 90 aa, Homo sapiens
GGAARQRQPDRALPGVHSKQSGPHPSECGSAELKRPDFSSTRCRFVFCFLVITVTQLITCMLFRIQLSSQAIKCLKFNIGLCKYSKLLFK

SEQ ID NO: 759143 - protein, 153 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKNFQNSGQLSY

SEQ ID NO: 759144 - protein, 702 aa, Homo sapiens; identical to SEQ ID NO: 759139

SEQ ID NO: 759145 - protein, 644 aa, Homo sapiens
PAYIFLPCWMLKARRTSDSKILQFWDLEWLSLLLSLQTAYRGTLPLHGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEVLRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVYIPSRVALILQNVDLPN

SEQ ID NO: 759146 - protein, 686 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEVLRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGNTALTFFLRLLNIMGVPILFWCTFQAEWPSSFRMWICRIEEA

SEQ ID NO: 759147 - protein, 170 aa, Homo sapiens
LVPNSARYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQVFFSFSTSIQARATLTTELEQHCQGNSKLC

SEQ ID NO: 759148 - protein, 719 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEVLRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQALVGDKSLAFWLMDAEMYTNMSVLTPFTPVIDRGIQLHKMIRLITHGLGGEGYLNFMGNEFGHPEWLDFPRKGNNESYHYARRQFHLTDDDLLRYKFLNNFDRDMNRLEERYGWLAAPQAYVSEKHEGNKIIAFERAGLLFIFNFHPSKSYTDYRVGTALPGKFKIVLDSDAAEYGGHQRLDHSTDFFSEAFEHNGRPYSLLVSKFLNIFPMQICVLFSCYHCHTAYNMYAFQNTVV

SEQ ID NO: 759149 - protein, 492 aa, Homo sapiens
MAAPMTPAARPEDYEAALNAALADVPELARLLEIDPYLKPYAVDFQRRYKQFSQILKNIGENEGGIDKFSRGYESFGVHRCADGGLYCKEWAPGAEGVFLTGDFNGWNPFSYPYKKLDYGKWELYIPPKQNKSVLVPHGSKLKVVITSKSGEILYRISPWAKYVVREGDNVNYDWIHWDPEHSYEFKHSRPKKPRSLRIYESHVGISSHEGKVASYKHFTCNVLPRIKGLGYNCIQLMAIMEHAYYASFGYQITSFFAASSRYGTPEELQELVDTAHSMGIIVLLDVVHSHASKNSADGLNMFDGTDSCYFHSGPRGTHDLWDSRLFAYSSWEVLRFLLSNIRWWLEEYRFDGFRFDGVTSMLYHHHGVGQGFSGDYSEYFGLQVDEDALTYLMLANHLVHTLCPDSITIAEDVSGMPALCSPISQGGGGFDYRLAMAIPDKWIQLLKEFKDEDWNMGDIVYTLTNRRYLEKCIAYAESHDQVNEYVHKFIY

SEQ ID NO: 759150 - protein, 698 aa, Homo sapiens
PSVPPCGSEALCRRPLLTSSSLGMDPSYCPAHGFPSQDPLWPLSSQQWSSAHYSEPAAGGCDGTEAMNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 759151 - protein, 370 aa, Homo sapiens
MPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 759152 - protein, 445 aa, Homo sapiens
HQFLLVGPRRSAAGPSSLLPPWGWIQAIVLPMASHLRTLSGRYHPSSGVQPTTLNQASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 759153 - protein, 711 aa, Homo sapiens
LERAELGCQRAARGTRRDREERRSLRGGERGREPSPPRAMSHRARGARPRSGQRSAGAPARSAAAARLYAAGGCDGTEAMNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 759154 - protein, 148 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 759155 - protein, 117 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQGIHCAKRIVSGARGMNNW

SEQ ID NO: 759156 - protein, 148 aa, Homo sapiens; identical to SEQ ID NO: 759154

SEQ ID NO: 759157 - protein, 93 aa, Homo sapiens
APYARLTKNWVMCVEELLSVRQEPCLFSPQGRMEVALFRPATLLLADRMPPEMKQGAGAPWSHSKTPVLTQGFFISSSYCLHFMLFSSLPIYN

SEQ ID NO: 759158 - protein, 250 aa, Homo sapiens
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGHGSTYFWHSFENYFPVGPLLSY

SEQ ID NO: 759159 - protein, 271 aa, Homo sapiens
SRIRSTEEQSQSSLFGNSGLEMDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGHGSTYFWHSFENYFPVGPLLSY

SEQ ID NO: 759160 - protein, 105 aa, Homo sapiens [sequence omitted]

SEQ ID NO: 759161 - protein, 89 aa, Homo sapiens
RKRGPGLTQEKNLKTHGLNHAHKKNNKGKKGPGKTPKLKKTWAASEWLIMSTQEMHIKFNREKSSLPLRLPIRLGRCRETGVHPGRCFG

SEQ ID NO: 759162 - protein, 198 aa, Homo sapiens
MCCSLVQSPQPQKGAMEADTPSGRPPALSCFGHCGRVQDPGILGGLWLCGQPAWPAQSACPEGETQVKPTDPLAPLLGPPGSQTTPPYPVLAQANERQGLPGLLLSRPLWGRRRCPQRLGGDSQEMGWHLHYPSSAAHGGLSGGGCWSLPPAPPLMSAPETKVGRVLKRKCLPRERLRLLLKHQPCGSCLQNLRPVKL

SEQ ID NO: 759163 - protein, 148 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQ

SEQ ID NO: 759164 - protein, 440 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759165 - protein, 115 aa, Homo sapiens
VPEVPDFDAFLLELQISNNRLEDAGVRELCQGLGQPGSVLRVLWLADCDVSDSSCSSLAATLLANHSLRELDLSNNCLGDAGILQLVESVPAAGLPPGAAGPVDIYWSEENASKS

SEQ ID NO: 759166 - protein, 440 aa, Homo sapiens; identical to SEQ ID NO: 759164

SEQ ID NO: 759167 - protein, 440 aa, Homo sapiens; identical to SEQ ID NO: 759164

SEQ ID NO: 759168 - protein, 440 aa, Homo sapiens; identical to SEQ ID NO: 759164

SEQ ID NO: 759169 - protein, 440 aa, Homo sapiens; identical to SEQ ID NO: 759164

SEQ ID NO: 759170 - protein, 507 aa, Homo sapiens
RGCVVNSAEAASYASNPGPAELASPNPVILDLIPPKKRPPGKERPGGEDSNGSHSRALGERPLFTSTMSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759171 - protein, 440 aa, Homo sapiens; identical to SEQ ID NO: 759164

SEQ ID NO: 759172 - protein, 522 aa, Homo sapiens
EAKQARSRLGVNWPRARAGSNTPAPLTGGWGCRHVQPVLLARERSRPSRSGSPGPRPSASRPEESPACETVRGFGQDVLFPLPPTQATLLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759173 - protein, 197 aa, Homo sapiens
MAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759174 - protein, 414 aa, Homo sapiens
MTLGSAHRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759175 - protein, 440 aa, Homo sapiens; identical to SEQ ID NO: 759164

SEQ ID NO: 759176 - protein, 440 aa, Homo sapiens; identical to SEQ ID NO: 759164

SEQ ID NO: 759177 - protein, 440 aa, Homo sapiens; identical to SEQ ID NO: 759164

SEQ ID NO: 759178 - protein, 440 aa, Homo sapiens; identical to SEQ ID NO: 759164

SEQ ID NO: 759179 - protein, 440 aa, Homo sapiens; identical to SEQ ID NO: 759164

SEQ ID NO: 759180 - protein, 68 aa, Homo sapiens
EAKQARSRLGVNWPRARAGSNTPAPLTGGWGCRHVQPVLLARERSRPSRSGSPGPRPSASRPEGMKNS

SEQ ID NO: 759181 - protein, 411 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLGMDVSDRVESSRTCWQTQLVNDSEMLGERHLDVK

SEQ ID NO: 759182 - protein, 418 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSVTTRTLPSHLCTMSCDKAATLSPSSMEPRIPSPAL

SEQ ID NO: 759183 - protein, 247 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKRAFRQPGCLLEQLVLYDIYWSEEMEDRLQALEKDKPSLRVIS

SEQ ID NO: 759184 - protein, 262 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKPCTTFTGLRRWRTGCRPWRRTSHP

SEQ ID NO: 759185 - protein, 262 aa, Homo sapiens; identical to SEQ ID NO: 759184

SEQ ID NO: 759186 - protein, 267 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELWGVPRSGRPWLGGPARGRRP

SEQ ID NO: 759187 - protein, 266 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKPHPAYPRFEEKRSDPLISASIFWTLYNH

SEQ ID NO: 759188 - protein, 177 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQSTEPSVQCEPWSGRASRSGPTVAQDIRGG

SEQ ID NO: 759189 - protein, 181 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLHCPLQGTAAPGPDGGNRCLAVSQVPLTASVCVGD

SEQ ID NO: 759190 - protein, 200 aa, Homo sapiens
EAKQARSRLGVNWPRARAGSNTPAPLTGGWGCRHVQPVLLARERSRPSRSGSPGPRPSASRPEVSSSSGASASSQASPTPALVGLLVDAGLALLRPLLRGRVARSRGGAGSGGAGVRGYRGGAEVALGSCAAGRTWRALRTSSRCTLPFGACRKSLPGGRGCACVVRPHVAVKPSSALDSSELRKQSWPSRACFPKSRNP

SEQ ID NO: 759191 - protein, 200 aa, Homo sapiens; identical to SEQ ID NO: 759190

SEQ ID NO: 759192 - protein, 267 aa, Homo sapiens; identical to SEQ ID NO: 759186

SEQ ID NO: 759193 - protein, 307 aa, Homo sapiens
MTRFIYWRTGRAVVSAVPGGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHYWSERMRTVRPGEGKPSGGIPEDSEGAPGTAENWAQPGVTGSR

SEQ ID NO: 759194 - protein, 440 aa, Homo sapiens; identical to SEQ ID NO: 759164

SEQ ID NO: 759195 - protein, 440 aa, Homo sapiens; identical to SEQ ID NO: 759164

SEQ ID NO: 759196 - protein, 440 aa, Homo sapiens; identical to SEQ ID NO: 759164

SEQ ID NO: 759197 - protein, 440 aa, Homo sapiens; identical to SEQ ID NO: 759164

SEQ ID NO: 759198 - protein, 197 aa, Homo sapiens; identical to SEQ ID NO: 759173

SEQ ID NO: 759199 - protein, 440 aa, Homo sapiens; identical to SEQ ID NO: 759164

SEQ ID NO: 759200 - protein, 414 aa, Homo sapiens; identical to SEQ ID NO: 759174

SEQ ID NO: 759201 - protein, 459 aa, Homo sapiens
MPWHYSHESSGTIAAVDVSMMRNGVRMRLDVLHPRLQSLSLGCQSWVLGARHELVVRVEREARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759202 - protein, 440 aa, Homo sapiens; identical to SEQ ID NO: 759164

SEQ ID NO: 759203 - protein, 397 aa, Homo sapiens
MGRAPPSAPAVPSGQAGRLWPHGSTVQGHQLCTSSQPCTGRAQPAQQRAGRCRRALRAPGPADPLLQDPEAEQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759204 - protein, 338 aa, Homo sapiens
RTVSRALLSWPCGQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGPVRHLLV

SEQ ID NO: 759205 - protein, 444 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVPAAGLPPGAAGVCARAGRVVRP

SEQ ID NO: 759206 - protein, 173 aa, Homo sapiens
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 759207 - protein, 172 aa, Homo sapiens
CSDLEDPEFGSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 759208 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 759209 - protein, 628 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKEQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 759210 - protein, 1276 aa, Homo sapiens
MGGEVRKRRSAAALNPVTSFPTSEILSGGVYIEKNDKLCHMDTIDWRDIVRDRDAEIVVKDNGRSCPPCHEVCKGRCWGPGSEDCQTCGFEIPSKNFTHTLSYPFLPKPGSTLWGRHEQWPQNSVLGALTAMLSLLSIVTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 759211 - protein, 1039 aa, Homo sapiens
MVRSCKETAFPLSLRRPPPLNLSYIAACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 759212 - protein, 331 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKGG

SEQ ID NO: 759213 - protein, 186 aa, Homo sapiens [sequence omitted]

SEQ ID NO: 759214 - protein, 183 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 759215 - protein, 1298 aa, Homo sapiens
MQSVNVEEPVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTCGFEIPSKNFTHTLSYPFLPKPGSTLWGRHEQWPQNSVLGALTAMLSLLSIVTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 759216 - protein, 400 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGLEILPSLLRPQPTHPSQFISLAKTFLCGAD

SEQ ID NO: 759217 - protein, 595 aa, Homo sapiens [sequence omitted]

SEQ ID NO: 759218 - protein, 193 aa, Homo sapiens
MLRSGNDERWNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759219 - protein, 294 aa, Homo sapiens
MTMTLHTKASGMALLHQIQGNELEPLNRPPSRMCLARDPDDWSRLALHGAPSEATVCSYTCSWTGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759220 - protein, 220 aa, Homo sapiens [sequence omitted]

SEQ ID NO: 759221 - protein, 700 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMRTRENVYEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHISTCNKGMEHLYSMKCKNVVPLYDLLLEMLDAHRLHAPTSRGGASVEETDQSHLATAGSTSSHSLQKYYITGEAEGFPATV

SEQ ID NO: 759222 - protein, 700 aa, Homo sapiens; identical to SEQ ID NO: 759221

SEQ ID NO: 759223 - protein, 386 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGELMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759224 - protein, 483 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759225 - protein, 171 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRMVLSCGLSSRVSHWMFREFM

SEQ ID NO: 759226 - protein, 595 aa, Homo sapiens [sequence omitted]

SEQ ID NO: 759227 - protein, 405 aa, Homo sapiens
SLARTSSAEYNVNNLVSPVLFQEALWHVPEHAVVLEIAPHALLQAVLKRGLKPSCTIIPLMKKDHRDNLEFFLAGIRRLHLSGIDANPNALFPPVEFPAPRGTPLISPLIKWDHSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759228 - protein, 334 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759229 - protein, 700 aa, Homo sapiens; identical to SEQ ID NO: 759221

SEQ ID NO: 759230 - protein, 700 aa, Homo sapiens; identical to SEQ ID NO: 759221

SEQ ID NO: 759231 - protein, 549 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLAEQGAGSHDQLGEEGARNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 759232 - protein, 382 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPERMDICVILGVPNAVAS

SEQ ID NO: 759233 - protein, 92 aa, Homo sapiens
SAGDMRAANLWPSPLMIKRSKKNSLALSLTADQMVSALLDAEPPILYSEYDPTRPFSEASMMGLLTNLADRELVHMINWAKRVPGKNAKRSF

SEQ ID NO: 759234 - protein, 569 aa, Homo sapiens
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALELCSKGAVLGEPFDAPAEDIASVASFIETKLVTCYLRMRKPDLALNHAHRSIVLNPAYFRNHLRQATVFRCLERYSEAARSAVIADYMFWLGGGREESISKLIKLYWQAMIEEAITRAESFSVMYTPFATKIRADKIEKVKDAFTKTHPAYAEYMYTDLQALHMLPQTVDWSSFPPQQYLLTLGFKNKDDGKFLEKISSRKLPIFTEHKTPFGLTREDTVRQMETMGKRILPILDFIRSTQLNGSFPASSGVMEKLQYASLLSQLQRVKEQSQVINQAMAELATIPYLQDISQQEAELLQSLMADAMDTLEGRRNNNERVWNMIQKVGQIEDFLYQLEDSFLKTKKLRTARRQKTKMKRLQTVQQR

SEQ ID NO: 759235 - protein, 207 aa, Homo sapiens
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALEVWD

SEQ ID NO: 759236 - protein, 532 aa, Homo sapiens
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALELCSKGAVLGEPFDAPAEDIASVASFIETKLVTCYLRMRKPDLALNHAHRSIVLNPAYFRNHLRQATVFRCLERYSEAARSAVIADYMFWLGGGREESISKLIKLYWQAMIEEAITRAESFSVMYTPFATKIRADKIEKVKDAFTKTHPAYAEYMYTDLQALHMLPQTVDWSSFPPQQYLLTLGFKNKDDGKFLEKISSRKLPIFTEHKTPFGLTREDTVRQMETMGKRILPILDFIRSTQLNGSFPASSGVMEKLQYASLLSQLQRVKEQSQVINQAMAELATIPYLQDISQQEAELLQSLMADAMDTLEGRRNNNERVWNMIQKVKL

SEQ ID NO: 759237 - protein, 76 aa, Homo sapiens
MGLVARDVSSPGVPASKQPDQASQWDVGKPVLADAVAGRSPERSPCPRGAEPQLLRSFGQDRWMQEAVGVWRICSH

SEQ ID NO: 759238 - protein, 74 aa, Homo sapiens
EEILGRTEAEPGSNSRKEKLRGRRAVREDILERPGPGRQHAGLQGGSVGVLKSLDSFFLLTPFILKSLPLAAQR

SEQ ID NO: 759239 - protein, 117 aa, Homo sapiens
KAGGQWCSLGSLQTPSPELKQFSCLSLLSSWDYRSPPPHPANFCTFSRDGQAGLKLLTSGDPPASASQSAWITVMSHHSQPLMVFWFLNFSRNAFYTTVPKITIYRYLKHCRISQKH

SEQ ID NO: 759240 - protein, 120 aa, Homo sapiens
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 759241 - protein, 120 aa, Homo sapiens; identical to SEQ ID NO: 759240

SEQ ID NO: 759242 - protein, 120 aa, Homo sapiens; identical to SEQ ID NO: 759240

SEQ ID NO: 759243 - protein, 120 aa, Homo sapiens; identical to SEQ ID NO: 759240

SEQ ID NO: 759244 - protein, 120 aa, Homo sapiens; identical to SEQ ID NO: 759240

SEQ ID NO: 759245 - protein, 120 aa, Homo sapiens; identical to SEQ ID NO: 759240

SEQ ID NO: 759246 - protein, 120 aa, Homo sapiens; identical to SEQ ID NO: 759240

SEQ ID NO: 759247 - protein, 120 aa, Homo sapiens; identical to SEQ ID NO: 759240

SEQ ID NO: 759248 - protein, 120 aa, Homo sapiens; identical to SEQ ID NO: 759240

SEQ ID NO: 759249 - protein, 120 aa, Homo sapiens; identical to SEQ ID NO: 759240

SEQ ID NO: 759250 - protein, 120 aa, Homo sapiens; identical to SEQ ID NO: 759240

SEQ ID NO: 759251 - protein, 120 aa, Homo sapiens; identical to SEQ ID NO: 759240

SEQ ID NO: 759252 - protein, 617 aa, Homo sapiens
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 759253 - protein, 617 aa, Homo sapiens; identical to SEQ ID NO: 759252

SEQ ID NO: 759254 - protein, 634 aa, Homo sapiens
SPPRGQPLGPRSVQSLHLAPQQLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 759255 - protein, 501 aa, Homo sapiens
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKVSC

SEQ ID NO: 759256 - protein, 617 aa, Homo sapiens; identical to SEQ ID NO: 759252

SEQ ID NO: 759257 - protein, 617 aa, Homo sapiens; identical to SEQ ID NO: 759252

SEQ ID NO: 759258 - protein, 519 aa, Homo sapiens
EFRRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVRPFQAQCGHRYCSFCLASILRKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759259 - protein, 131 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMV

SEQ ID NO: 759260 - protein, 182 aa, Homo sapiens
RSVGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSATTSSGASRRSRGPSRRTWPKRTSFPPLSLITLEIFLQQETRAAELLFFSVNKRIKAGLILGEQYTCLQHLSKS

SEQ ID NO: 759261 - protein, 114 aa, Homo sapiens
LCAARVQAEDRQNGPGGTVEDEDGEDGPGGTVEDEDGEDGPGGVWRTGMGRMGLGTWWRTGTGRMGLGMWWRTRTGGGWAWGHVEDEDGEDGSGGTWWRTRMGRMGLGARGGED

SEQ ID NO: 759262 - protein, 519 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759263 - protein, 556 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAAGSADCICWELCTKRWVKGQHCGGPARRWSSWELHSAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759264 - protein, 519 aa, Homo sapiens; identical to SEQ ID NO: 759262

SEQ ID NO: 759265 - protein, 519 aa, Homo sapiens; identical to SEQ ID NO: 759262

SEQ ID NO: 759266 - protein, 501 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759267 - protein, 501 aa, Homo sapiens; identical to SEQ ID NO: 759266

SEQ ID NO: 759268 - protein, 501 aa, Homo sapiens; identical to SEQ ID NO: 759266

SEQ ID NO: 759269 - protein, 501 aa, Homo sapiens; identical to SEQ ID NO: 759266

SEQ ID NO: 759270 - protein, 508 aa, Homo sapiens
SSGRAATVGALFAGVTALMAAASVTPPGSLELLQPGFSKTLLGTKLEAKYLCSACRNVLRRPFQAQCGHRSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759271 - protein, 519 aa, Homo sapiens; identical to SEQ ID NO: 759262

SEQ ID NO: 759272 - protein, 474 aa, Homo sapiens
LAARLPLPPGSLVLLLLGFLLLLGVAGLLRSCLVVLSAVFVVWPLVFLGLFLAFLCCLFGFFCWFFFFLLFGFFCFVFVVVVLLVVCSVMVVSGVLFFFFCFVGCLFLFVCFVYCVCFGVLVRHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759273 - protein, 536 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAMPGWLWERVWSHAASAQTTVWEVHSTACG

SEQ ID NO: 759274 - protein, 144 aa, Homo sapiens
RGCGRLPSIPENRNLTELVVAVTDENIVGLFAALLAERRVLLTASKLSTLTSCVHASCALLYPLLRWPFNQKVTLMLLDQNNREHVIDAFRPDVTSSSFQRPVNDMNIASGCPLFCPVSKMEAKNSYVRDDAIFIKAIVDLTGL

SEQ ID NO: 759275 - protein, 266 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETGFAVSARQGCSGMISAHCSVNL

SEQ ID NO: 759276 - protein, 249 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVSRGV

SEQ ID NO: 759277 - protein, 253 aa, Homo sapiens
SSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKVSVLHLLGGPQGGAHVLDVRVPWVGVGQVMTLVP

SEQ ID NO: 759278 - protein, 82 aa, Homo sapiens
AGVTALMAAASVTPPGSLELLQPGFSKTLLGTKLEAKYLCSACRNVLRRPFQAQCGHRYCSFCLASILRCMGPAGWEEGQAG

SEQ ID NO: 759279 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 759280 - protein, 288 aa, Homo sapiens; identical to SEQ ID NO: 759279

SEQ ID NO: 759281 - protein, 115 aa, Homo sapiens
SISRLPRTRPRQLGSEQDSEVFPSDQGVKKNCMQIESAKLLPDTPVQFIPPNTLNLRSFTKIIKRLAELHPEVSRDHIINALQEVRIRHKGFLNGLSITTIVEMTSSLLKNSASS

SEQ ID NO: 759282 - protein, 115 aa, Homo sapiens; identical to SEQ ID NO: 759281

SEQ ID NO: 759283 - protein, 148 aa, Homo sapiens
AAAPPRFPPPAAWPGGRGAAASLRASGCSGERRPGSLGPPAPGVLREWGLRPRGQTPVRPGPAWSPGARMKVTVCFGRTGIVVPCKEGQLRVGELTQQALQRYLKTREKVSAARRSGARLQPRHLPGSWLLGEDSSLRIYRWRNPGSR

SEQ ID NO: 759284 - protein, 110 aa, Homo sapiens
AAAPPRFPPPAAWPGGRGAAASLRASGCSGERRPGSLGPPAPGVLREWGLRPRGQTPVRPGPAWSPGARMKVTVCFGRTGIVVPCKEGQLRVGELTQQALQRYLKTREKA

SEQ ID NO: 759285 - protein, 256 aa, Homo sapiens
AAAPPRFPPPAAWPGGRGAAASLRASGCSGERRPGSLGPPAPGVLREWGLRPRGQTPVRPGPAWSPGARMKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPVGILLLVVLMKDQSAVPIG

SEQ ID NO: 759286 - protein, 372 aa, Homo sapiens
MLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 759287 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 759288 - protein, 383 aa, Homo sapiens
RDRGSARPGTAFLCGFTAQRASWTWVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 759289 - protein, 837 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759290 - protein, 811 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQGAVGPKVALKPPIQRKQGAGAPTAP

SEQ ID NO: 759291 - protein, 943 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRWVWRTNARAPAGGEEGLSLWWGWGREAGRVPPPPTQAFAVLHGGLLRGRQAQEAHPPVPWGLKSPAGGCWWQGRGSCRQQTGASGPSGQDQATLKPTAHPAPTPLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759292 - protein, 870 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGEAARPCRARVCWRYEVGGEGARPPPPMLPRLPSSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759293 - protein, 375 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRWVWRTNARAPAGGEEGLSLWWGWGREAGRVPPPPTQAFAVLHGGLLRGRQAQEAHPPVPWGLKSPAGGCWWQGRGSCRQQTGASGPSGQDQATLKPTAHPAPTPLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKVGSGPGCRGARAPGGRWGGVL

SEQ ID NO: 759294 - protein, 83 aa, Homo sapiens
ARSVGSFVPGPEKVMSRLEPGLPGGPMSAVSVSSQVIKPTFAPPVPPVKPGAGAANPGPAEVRPQHTPGRVHCAMDGTASPRG

SEQ ID NO: 759295 - protein, 902 aa, Homo sapiens
AGLSPPPLLPDPAMRGLGLWLLGAMMLPAIAPSRPWALMEQYEVVLPRRLPGPRVRRALPSHLGGQFRPQPCPYLSIRGTYYRPARCPGLIQPVAQLRLSQSSAGRAPACTWGLEMQWSSRRLCRHHQGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759296 - protein, 941 aa, Homo sapiens
AGLSPPPLLPDPAMRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEVLHAPYLLPSALGATTSVPSGQGDHCTSTRGTWGSVGVQSGHREGVAAGHPSGQGRRPGPPWSPARPQCSLPRPLPSPQDCRNRCCNSTTCQLAEGAQCAHGTCCQECKVKPAGELCRPKKDMCDLEEFCDGRHPECPEDAFQENGTPCSGGYCYNGACPTLAQQCQAFWGPGEVGTELAWQGGCRPCQGYPAPGPTGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759297 - protein, 527 aa, Homo sapiens
SKKQNTNNRTRTHTLVLSLGYRDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 759298 - protein, 283 aa, Homo sapiens
LQSSEPPTAAAMLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRFYGELLPGPASWVTCKPNSSPPPPGRPDSHPSTPPEQWDFLLPFQRITTAQKTMTWSSVSPSPSCCTPAPRPWGGCSLGAESLAEVINKPLEH

SEQ ID NO: 759299 - protein, 136 aa, Homo sapiens
MAARKSHIQLKKGGETPLNACILSSGSSALVRCSGARRSSLLFPPPCSELLAAGPDAASHEQRIDLGAWWVISAQTKHENPKSSGTGHRPATAAHACPGDSRQCRGKGEIIHSAIHSLTQAIIHSFIQQILTESSL

SEQ ID NO: 759300 - protein, 122 aa, Homo sapiens
MVPPSSVFIRTWFQAEISTQRLFSFNSNPASNFGTLGNIFTHLSFPFREQEIIYIVELFGAGTGNHAHQRFNIRFNIIQMLPSFSCSHHMTDIPAPILPSTMIVSFLKPSPEAKEIIGAMLI

SEQ ID NO: 759301 - protein, 107 aa, Homo sapiens
PRYLQLLPDTFLTGPPSPSHLGSYRSPAGSRPPMCASASASLEQAYCGGGRGQAAGIRKLSLALVEREQQGSSGHSETHMSTSAVALGGGDKGAVENGSNLVYFKTH

SEQ ID NO: 759302 - protein, 192 aa, Homo sapiens
QSSSHQHDHVNPKAFFSVLRIYLSGWKGNPQLSDGLVYEGFWEDPKEFAGGSAGQSSVFQCFDVLLGIQQTAGGGHAAQFLQDMRRYMPPAHRNFLCSLESNPSVREFVLSKGDAGLREAYDACVKALVSLRSYHLQIVTKYILIPASQQPKENKTSEDPSKLEAKGTGGTDLMNFLKTVRSTTEKSLLKEG

SEQ ID NO: 759303 - protein, 418 aa, Homo sapiens
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKPLTYESIASWLLFIRPLTYENMDVLFSFRDGDCSKGFFLVSLLVEIAAASAIKVIPTVFKAMQMQERDTLLKALLEIASCLEKALQVFHQIHDHVNPKAFFSVLRIYLSGWKGNPQLSDGLVYEGFWEDPKEFAGGSAGQSSVFQCFDVLLGIQQTAGGGHAAQFLQDMRRYMPPAHRNFLCSLESNPSVREFVLSKGDAGLREAYDACVKALVSLRSYHLQIVTKYILIPASQQPKENKTSEDPSKLEAKGTGGTDLMNFLKTVRSTTEKSLLKEG

SEQ ID NO: 759304 - protein, 201 aa, Homo sapiens
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKPLTYENMDVLFSFRDGDCSKGFFLVSLLVEIAAASAIKVRLSSLQNLYVNLRKQSNHFGA

SEQ ID NO: 759305 - protein, 403 aa, Homo sapiens [sequence omitted]

SEQ ID NO: 759306 - protein, 154 aa, Homo sapiens
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKPLTYESIASWLLS

SEQ ID NO: 759307 - protein, 136 aa, Homo sapiens
MMCLMITNFIWNTNFQFVHMMHRDAFVVLLVFILQTKKLENETIPKVEVISHCPCDKLWSLAVAATIIRCSENSSDTEGHQRSRLQEWHTLWKTPGQSVKSTILMKKWALLCQIHRKIYLIFIMTGCSLLNICLIS

SEQ ID NO: 759308 - protein, 170 aa, Homo sapiens
DCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASRLLGLLICGSLALITGLTFAIFRRRKVIDFIKSSLFGLGSGVAEQTQVPKEKATDSRQQ

SEQ ID NO: 759309 - protein, 71 aa, Homo sapiens
MEGSRFHSKSSGEPLKAYGKGVGCHLFPVAAMEEVGTRKGETSGKAAVEAPGDAGVTSATAAAGGMENQGL

SEQ ID NO: 759310 - protein, 127 aa, Homo sapiens
MCSAYPPTVTSVVEPLTSQGSIWEGEKSTHSIWGCCSSHISLPGGMWGCLPPCPPSADVPPLRLSRCHLTQAAVQRQAGKPKPHSQGGPQPPESRFSRGYDLRRLRGKTGGKEKSYNCQEWGTFPCP

SEQ ID NO: 759311 - protein, 479 aa, Homo sapiens
VPGGPMPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVSRGSCGHAPCTRVSAGWLQVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 759312 - protein, 401 aa, Homo sapiens
VPGGPMPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVSRGSCGHAPCTRVSAGWLQASVPERRGVRVSVPLRGGEWVSL

SEQ ID NO: 759313 - protein, 459 aa, Homo sapiens
VPGGPMPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 759314 - protein, 249 aa, Homo sapiens
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 759315 - protein, 249 aa, Homo sapiens; identical to SEQ ID NO: 759314

SEQ ID NO: 759316 - protein, 287 aa, Homo sapiens
AGRRKRMPSPGRRRSGPQLWRREILIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 759317 - protein, 279 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759318 - protein, 279 aa, Homo sapiens; identical to SEQ ID NO: 759317

SEQ ID NO: 759319 - protein, 297 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVSIEKFLCGDYSFGKLEHVLTYHLSGVGRRQPCLICGSSIQVLFYFNGDGKWSSHIYNSEHRTQADTLKLDDYF

SEQ ID NO: 759320 - protein, 279 aa, Homo sapiens; identical to SEQ ID NO: 759317

SEQ ID NO: 759321 - protein, 301 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVIMLCCLSSFCNSWTFHSRIMRPPWRKVCGT

SEQ ID NO: 759322 - protein, 373 aa, Homo sapiens
AEAAARRGAAESARVLPVTRRCSRPSHPSLPSPGCAAGAGTRLRSPRRLHPRGRSSSRRPRAHHDEEREEVPQPEPGRVEALHLQPDHRRIPGAHRQELGIAVCGREVMLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759323 - protein, 222 aa, Homo sapiens
MWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759324 - protein, 230 aa, Homo sapiens
TRRGRVGRPTRPLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759325 - protein, 212 aa, Homo sapiens
MLGHNTDRFLARRLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759326 - protein, 104 aa, Homo sapiens
MTKNEKKSLNQSLAEWKLFIYNPTTGEFLGRTAKSWGLILLFYLVFYGFLAALFSFTMWVMLQTLNDEVPKYRDQIPSPAHWNIHSVGLIQLRMQGTLKTLRSF

SEQ ID NO: 759327 - protein, 279 aa, Homo sapiens; identical to SEQ ID NO: 759317

SEQ ID NO: 759328 - protein, 269 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTCPSEVTALLPLLPFEPSVQSPR

SEQ ID NO: 759329 - protein, 127 aa, Homo sapiens
HASRTRGSTHASAQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759330 - protein, 297 aa, Homo sapiens; identical to SEQ ID NO: 759319

SEQ ID NO: 759331 - protein, 99 aa, Homo sapiens
GDLRHPHLCKHDRRNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759332 - protein, 209 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPMVILSESGRI

SEQ ID NO: 759333 - protein, 373 aa, Homo sapiens; identical to SEQ ID NO: 759322

SEQ ID NO: 759334 - protein, 126 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKQLSARLMDQPT

SEQ ID NO: 759335 - protein, 279 aa, Homo sapiens; identical to SEQ ID NO: 759317

SEQ ID NO: 759336 - protein, 279 aa, Homo sapiens; identical to SEQ ID NO: 759317

SEQ ID NO: 759337 - protein, 204 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKLVGVLVISAI

SEQ ID NO: 759338 - protein, 222 aa, Homo sapiens; identical to SEQ ID NO: 759323

SEQ ID NO: 759339 - protein, 284 aa, Homo sapiens
LNLDSEKALKRIAVCGREVMLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759340 - protein, 279 aa, Homo sapiens; identical to SEQ ID NO: 759317

SEQ ID NO: 759341 - protein, 212 aa, Homo sapiens
YPSIRRAQSPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 759342 - protein, 279 aa, Homo sapiens; identical to SEQ ID NO: 759317

SEQ ID NO: 759343 - protein, 123 aa, Homo sapiens [sequence omitted]

SEQ ID NO: 759344 - protein, 279 aa, Homo sapiens; identical to SEQ ID NO: 759317

SEQ ID NO: 759345 - protein, 488 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTTSPEPPTYQAYDEHRPASRAHPLAPPDPRVRYVRPLQYLTDQHARKEANGPHNIFSYVHQVTKQTNPEREFNVKSLYCIVRKLPFTHAGLSFLIAAAPNTAQTNKRLYKASVCCRTMFGVLRNDARYHEMILHSQTHPPVRHPRPHCSSPHPQAPTIRGRTTQSPQTHAPTPPHSLGLLSTPTHVAYQSMRTPHNVPVSNISPSTRPNLKTTHETSNNRQRSAEMTHTITTPRPLLHPPSP

SEQ ID NO: 759346 - protein, 116 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKQ

SEQ ID NO: 759347 - protein, 131 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKRWVSTAIGCCSGQLCS

SEQ ID NO: 759348 - protein, 204 aa, Homo sapiens; identical to SEQ ID NO: 759337

SEQ ID NO: 759349 - protein, 218 aa, Homo sapiens
LVRLAPGGSAPGAAPAAAMDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKVGSAAPPTALSPWFRLLKSVCTIRKGFSWGLL

SEQ ID NO: 759350 - protein, 264 aa, Homo sapiens
LVRLAPGGSAPGAAPAAAMDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQY

SEQ ID NO: 759351 - protein, 401 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFNKKHFRAGANMENHNSALAAEASEESLFSASKNLNMPLTRESSVRQIIANSSVPIRSGFPPPSPSTSVGPSEQIATDQHAILNQLTTIHMHSHSTYMQARGHIVNFITTTTSQYHIISPLQNGYFGLTVEPSAVPTRYPLVSVNEAPYRNMLPAGNPWLQMPTIADRSAAPHSRLALQPSPLDKYHPNYN

SEQ ID NO: 759352 - protein, 204 aa, Homo sapiens [sequence omitted]

SEQ ID NO: 759353 - protein, 188 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFLVSSTKMISHHQTQKMNKILLPWKSCL

SEQ ID NO: 759354 - protein, 188 aa, Homo sapiens; identical to SEQ ID NO: 759353

SEQ ID NO: 759355 - protein, 188 aa, Homo sapiens; identical to SEQ ID NO: 759353

SEQ ID NO: 759356 - protein, 188 aa, Homo sapiens; identical to SEQ ID NO: 759353

SEQ ID NO: 759357 - protein, 188 aa, Homo sapiens; identical to SEQ ID NO: 759353

SEQ ID NO: 759358 - protein, 188 aa, Homo sapiens; identical to SEQ ID NO: 759353

SEQ ID NO: 759359 - protein, 77 aa, Homo sapiens
SNFWLVAAVLGQGKEGTRRPPSPRHLLPASPQPRLREMCRAGGPGSPSRRRDTLGRPQSGAGQSQHRSIDFFELGIS

SEQ ID NO: 759360 - protein, 188 aa, Homo sapiens; identical to SEQ ID NO: 759353

SEQ ID NO: 759361 - protein, 122 aa, Homo sapiens
LIFGWWRRCWARGRKGHGGRPRPATSYQLPPSPGSGRCAGRGARVRRAAGETRWADPRAALDRKTFKVDDMLSKVEKMKGEQESHSLSAHLQLTFLVSSTKMISHHQTQKMNKILLPWKSCL

SEQ ID NO: 759362 - protein, 188 aa, Homo sapiens; identical to SEQ ID NO: 759353

SEQ ID NO: 759363 - protein, 122 aa, Homo sapiens; identical to SEQ ID NO: 759361

SEQ ID NO: 759364 - protein, 188 aa, Homo sapiens; identical to SEQ ID NO: 759353

SEQ ID NO: 759365 - protein, 188 aa, Homo sapiens; identical to SEQ ID NO: 759353

SEQ ID NO: 759366 - protein, 165 aa, Homo sapiens
GLGRVSGSEAERGSEETLFLPPSFPPLLLPSLPLSSPLSSFSPRSAGACWGERLVLQALTLRGRPASSWPGKEAGTAMAPQKHGGGGGGGSGPSAGSGGGGFGGSAATASSGKSGGGGCGGGGSYSASSSSAALPVKKSKMEHVQADHELFLQAFEKPTQIYRFL

SEQ ID NO: 759367 - protein, 188 aa, Homo sapiens; identical to SEQ ID NO: 759353

SEQ ID NO: 759368 - protein, 218 aa, Homo sapiens
SNFWLVAAVLGQGKEGTRRPPSPRHLLPASPQPRLREMCRAGGPGSPSRRRDTLGRPQSGAGQLVSSFAAYIFGFFHKNDKPSPNSENEQNSVTLEVLLVKVCHKKRKDVCCPIRQVPTGKKQVPLNPDLNQTKPGNFPSLAVSSNEFEPSNSHMVKSYSLLFRVTRPRRREFNGMINGETMKILVIFFFTRFYHWRLRWSLKMIVPVFLHDSHGAES

SEQ ID NO: 759369 - protein, 165 aa, Homo sapiens; identical to SEQ ID NO: 759366

SEQ ID NO: 759370 - protein, 165 aa, Homo sapiens; identical to SEQ ID NO: 759366

SEQ ID NO: 759371 - protein, 1280 aa, Homo sapiens
SAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 759372 - protein, 212 aa, Homo sapiens
RGSRASTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 759373 - protein, 161 aa, Homo sapiens
MLNDSLNLHRYSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 759374 - protein, 1201 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLILPRF

SEQ ID NO: 759375 - protein, 1199 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIYN

SEQ ID NO: 759376 - protein, 757 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDNTEELQLLQGTVVGQAAV

SEQ ID NO: 759377 - protein, 1204 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 759378 - protein, 278 aa, Homo sapiens [sequence omitted]

SEQ ID NO: 759379 - protein, 1204 aa, Homo sapiens; identical to SEQ ID NO: 759377

SEQ ID NO: 759380 - protein, 75 aa, Homo sapiens
RCTATPGWLLATQADQLCRLFGGSSGLALLTELSQNRSSESYRPFSGSQSAPAFNSIFQNENFQLQLIPPPVTED

SEQ ID NO: 759381 - protein, 282 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWREVSSK

SEQ ID NO: 759382 - protein, 876 aa, Homo sapiens
MWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERRTKQTSKR

SEQ ID NO: 759383 - protein, 690 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 759384 - protein, 690 aa, Homo sapiens; identical to SEQ ID NO: 759383

SEQ ID NO: 759385 - protein, 690 aa, Homo sapiens; identical to SEQ ID NO: 759383

SEQ ID NO: 759386 - protein, 143 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGGDHWRCLLCSWGITQRE

SEQ ID NO: 759387 - protein, 286 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPIKHFSRPQFAYNLYSKSL

SEQ ID NO: 759388 - protein, 34 aa, Homo sapiens
QIALMALKMMELSDEVMSPHGEPIKVRQMIYCPK

SEQ ID NO: 759389 - protein, 690 aa, Homo sapiens; identical to SEQ ID NO: 759383

SEQ ID NO: 759390 - protein, 690 aa, Homo sapiens; identical to SEQ ID NO: 759383

SEQ ID NO: 759391 - protein, 366 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVRKT

SEQ ID NO: 759392 - protein, 624 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYR

SEQ ID NO: 759393 - protein, 434 aa, Homo sapiens
GNEKITLFHCGERADVQPQNFWNCFLVLAALVTLSTLKRTVLLRGRHSPTVLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759394 - protein, 81 aa, Homo sapiens
YYYKIRGRVEKKRNGHEQLQAYSCLLGYPIRRECLFIPSSSSNARLSHMTTSEPITEALGRKASDWISQGHTVNPSARPGN

SEQ ID NO: 759395 - protein, 115 aa, Homo sapiens
KWPLYMSTKNTILKAYDGRFKDIFQEIFDKHHWQAAHGAQYKATDFVADRAGTFKMVFTPKDGSGVKEWEVYNFPAGGVGMGMYNTDELISGLRTVLQYASEEWPHHAAVRAGYG

SEQ ID NO: 759396 - protein, 452 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759397 - protein, 489 aa, Homo sapiens
LNLPNSREPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759398 - protein, 452 aa, Homo sapiens; identical to SEQ ID NO: 759396

SEQ ID NO: 759399 - protein, 492 aa, Homo sapiens
PARPAPARPSVPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759400 - protein, 452 aa, Homo sapiens; identical to SEQ ID NO: 759396

SEQ ID NO: 759401 - protein, 452 aa, Homo sapiens; identical to SEQ ID NO: 759396

SEQ ID NO: 759402 - protein, 452 aa, Homo sapiens; identical to SEQ ID NO: 759396

SEQ ID NO: 759403 - protein, 452 aa, Homo sapiens; identical to SEQ ID NO: 759396

SEQ ID NO: 759404 - protein, 510 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDNKASSMYSVAFLPFPPCCSHPTLGRSLLECIWLSSEAQGGIPNLSAFCPLPITDLFTPRHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759405 - protein, 458 aa, Homo sapiens
MASVHSSLTNGTGPCQEREREREEGTKGRKEGKKGKEGKKGKEVNADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759406 - protein, 322 aa, Homo sapiens
MWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759407 - protein, 311 aa, Homo sapiens
YGLVSLGHFGRGCKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 759408 - protein, 346 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYDAAEGEPHSPSLEAFLGDVFL

SEQ ID NO: 759409 - protein, 293 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDEVRLAWASWAPPLPACLFISVSWLSFLL

SEQ ID NO: 759410 - protein, 95 aa, Homo sapiens
MISSVWPSPYGAQKAATGPPCRLADTGGEVMETASQFAQMLEKVCVETVESGAMTKDLAGCIHGLSNVKLNEHFLNTTDFLDTIKSNLDRALGRQ

SEQ ID NO: 759411 - protein, 243 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRSPGQAVGGGATHGCSGGARAEPAGPPERGRG

SEQ ID NO: 759412 - protein, 243 aa, Homo sapiens; identical to SEQ ID NO: 759411

SEQ ID NO: 759413 - protein, 299 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKGHRHLLARTGARAPFQKWGLSTPKRRCQWDVQGKCGNVVITISPDGELRAIGRIVTKPGRKTISRIGRTQLVTRYTIQD

SEQ ID NO: 759414 - protein, 176 aa, Homo sapiens
MWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYDAAEGEPHSPSLEAFLGDVFL

SEQ ID NO: 759415 - protein, 135 aa, Homo sapiens
GKRIGRLQSPHICTLDSTAFLMKNFRTPVWLCCCLGFKFWLKDGGCSGTTIISVLTEFKLKKMWKSPNGTIRNILGGTVFREPIICKNIPRLVPGWTKPITIGRSPGQAVGGGATHGCSGGARAEPAGPPERGRG

SEQ ID NO: 759416 - protein, 245 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWPLPLGRAPGAPSPGPAFVGARGGPFPLVFPPPGRGVPAWAV

SEQ ID NO: 759417 - protein, 139 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTID

SEQ ID NO: 759418 - protein, 160 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKLILPHVDIQLKYFDLGLPNRDQRLSRRVLLSAAEGEPHSPSLEAFLGDVFL

SEQ ID NO: 759419 - protein, 142 aa, Homo sapiens
MRPQRHTYSKKKLMQQGRRAQTTRNKETRNTKKSRRQGKQKKSKAERKQQRETERKKKNRTRKGGRREGEGRRGQGTKRAASEHKEKKRRAGEEEKKQGRGGGGREGGRDDDRGREQRQGGGEETREGNAEEERRQGREQEG

SEQ ID NO: 759420 - protein, 124 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKHNQPHETTNKKKKTT

SEQ ID NO: 759421 - protein, 311 aa, Homo sapiens
AAGTGLRCYGWPSVSPRPGSREERRALGPLPPCSFALQLGMAGYLRVVRSLCRASGSRPAWAPAALTAPTSQEQPRRHYADKRIKVAKPVVEMDGDEMTRIIWQFIKEKHSAVKHAERYFNHGPTTNTWTHELNDTVVTTLELLLDTKKSCWRKVVATTPEMKVPLWKEVSKERKNVGKKFPKWKQIRETIPVGGELLSGVDPIHVKKTPTSLVPLCLVKSSGGERPGTQLQGPQTFVGKNRGPGTFSKMGSFNPKKKVEVRCSGEVRKCGITISPDGELRAIGRIVTKPGRKTISRIGRTQLVTRYTIQD

SEQ ID NO: 759422 - protein, 732 aa, Homo sapiens
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 759423 - protein, 763 aa, Homo sapiens
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQPQRSELLFSFPVSIQLVPDQHQSETDLGTEKMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 759424 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 759425 - protein, 282 aa, Homo sapiens
MVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 759426 - protein, 106 aa, Homo sapiens [sequence omitted]

SEQ ID NO: 759427 - protein, 232 aa, Homo sapiens
MDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 759428 - protein, 292 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTPVQCFEILPTSPSSPAGSGAVQCGQHGEESHFLGGQYSSLSLITLEMLFLLYHPCSTF

SEQ ID NO: 759429 - protein, 164 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQK

SEQ ID NO: 759430 - protein, 106 aa, Homo sapiens [sequence omitted]

SEQ ID NO: 759431 - protein, 246 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKFFRGHKLTTRLTVDVLGNLSSTCPQMTTLYLTFTLEKSTHVGHQMKGWPAPLHLVGVSHQVGRETEKRKKRLGAVGSTPCIP

SEQ ID NO: 759432 - protein, 232 aa, Homo sapiens; identical to SEQ ID NO: 759427

SEQ ID NO: 759433 - protein, 308 aa, Homo sapiens; identical to SEQ ID NO: 759424

SEQ ID NO: 759434 - protein, 180 aa, Homo sapiens
MGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 759435 - protein, 308 aa, Homo sapiens; identical to SEQ ID NO: 759424

SEQ ID NO: 759436 - protein, 292 aa, Homo sapiens; identical to SEQ ID NO: 759428

SEQ ID NO: 759437 - protein, 138 aa, Homo sapiens
MVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQK

SEQ ID NO: 759438 - protein, 76 aa, Homo sapiens
GGGAGPISKDRKERVHQGMVRAATVGYGILREGGSAVDAVEGAVVALEDDPEFNAGKCAFQLVNNVSQVKLLLQNK

SEQ ID NO: 759439 - protein, 49 aa, Homo sapiens
MTSTVNFSDKPSITRSINGKTICSQQHPGGTPCTKTHQWRQMFSMANAD

SEQ ID NO: 759440 - protein, 66 aa, Homo sapiens
RDPPIIGTSLIIGTPPISMNFEVPFAPSGLKVRYLKVFEPKLNYSDHDVIKWVRYIGRSGIYETRC

SEQ ID NO: 759441 - protein, 145 aa, Homo sapiens
ALGLSKDVYNSEYYTSPGLGAAALDVCRSLPHHTSVSPPSCFAAFPLHQPESRSGPSTLQVGPVEQPLGSLGRGVLRLLLSHPPVCPGLMPGSEFCDQSPGGFPFLPTPVATALEWEGWLPLTSELPQRPVMDPRPQSLLCFGIV

SEQ ID NO: 759442 - protein, 251 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 759443 - protein, 251 aa, Homo sapiens; identical to SEQ ID NO: 759442

SEQ ID NO: 759444 - protein, 251 aa, Homo sapiens; identical to SEQ ID NO: 759442

SEQ ID NO: 759445 - protein, 251 aa, Homo sapiens; identical to SEQ ID NO: 759442

SEQ ID NO: 759446 - protein, 238 aa, Homo sapiens
MSPQGQVLSAHVSGRVVMKSYLSGMPECKFGMNDKIVIDGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 759447 - protein, 242 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEGMAEEGPRVMPGYAGRPLRDHSDKPLHLRGEETEA

SEQ ID NO: 759448 - protein, 170 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWK

SEQ ID NO: 759449 - protein, 211 aa, Homo sapiens
MSPQGQVLSAHVSGRVVMKSYLSGMPECKFGMNDKIVIEKQGKGTADETSKRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 759450 - protein, 139 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIESR

SEQ ID NO: 759451 - protein, 251 aa, Homo sapiens; identical to SEQ ID NO: 759442

SEQ ID NO: 759452 - protein, 196 aa, Homo sapiens
MAAYFGKISEENIKNNFVLIYELLDEILDFGYPQNSETGALKTFISAAGHQESASDKRRAVTDHQPGNWADWLAARGYQSRWVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 759453 - protein, 249 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWPLRPMKRTHLMR

SEQ ID NO: 759454 - protein, 244 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWPSPQLVK

SEQ ID NO: 759455 - protein, 212 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEQQEAS

SEQ ID NO: 759456 - protein, 243 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARGGEWRESGGWGREGRHPYQTQTDAAAPWSQGCWPRVAGLEKAQV

SEQ ID NO: 759457 - protein, 170 aa, Homo sapiens; identical to SEQ ID NO: 759448

SEQ ID NO: 759458 - protein, 231 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIESRCPTHEHSGVRDLLRGGQLQQRDASVGDQALQLRSKQARGLLQEEKGSPLRMGARLARAEGAGHGQVHTGGATREGPPTGATTGTESWQQGTE

SEQ ID NO: 759459 - protein, 151 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIESRCPHPTDTRGECR

SEQ ID NO: 759460 - protein, 167 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIELRAPPKASNGSPASVPTLLWDSVSFILYTC

SEQ ID NO: 759461 - protein, 189 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRSHNQGLFIYNHKGEVLISRVYRDDIGRNAVDAFRVNVIHARQQVRSPVTNIARTSFFHVKRSNIWLAAVTKQNVNAAMVFEFLYKMCDVMRLLKRIS

SEQ ID NO: 759462 - protein, 92 aa, Homo sapiens
LGRASVGRVMAAYFGKISEENIKNNFVLIYELLDEILDFGYPQNSETGALKTFISAAGHQESASDKRRAVTDHQPGNWADWLAARGYQVSSE

SEQ ID NO: 759463 - protein, 66 aa, Homo sapiens; identical to SEQ ID NO: 759440

SEQ ID NO: 759464 - protein, 92 aa, Homo sapiens
DPRVRTHASGKIKRMAGMKESQISAEIELLPTNDKKKWARPPISMNFEVPFAPSGLKVRYLKVFEPKLNYSDHDVIKWVRYIGRSGIYETRC

SEQ ID NO: 759465 - protein, 251 aa, Homo sapiens; identical to SEQ ID NO: 759442

SEQ ID NO: 759466 - protein, 251 aa, Homo sapiens; identical to SEQ ID NO: 759442

SEQ ID NO: 759467 - protein, 254 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIESRRVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 759468 - protein, 242 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVRYLKVFEPKLNYSDHDVIKWVRYIGRSGIYETRC

SEQ ID NO: 759469 - protein, 251 aa, Homo sapiens; identical to SEQ ID NO: 759442

SEQ ID NO: 759470 - protein, 251 aa, Homo sapiens; identical to SEQ ID NO: 759442

SEQ ID NO: 759471 - protein, 312 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWCPGKLPNFPATLLHRVKSRFLPNHTSAAPSFCFGGFPFDQAPARLRPSTFPSRNPSTQPLGVLGKGKLMRPVFPL

SEQ ID NO: 759472 - protein, 242 aa, Homo sapiens; identical to SEQ ID NO: 759447

SEQ ID NO: 759473 - protein, 221 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEAIRALWPCTWPSPS

SEQ ID NO: 759474 - protein, 236 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVPLPPPPHISVSSLLLCCLQPLGSLGRGVLRLLLSHPPVCPGLMPGSEFCDQSPGGFPFLPTPVATALEWEGWLPLTSELPQRPVMDPRPQSLLCFGIV

SEQ ID NO: 759475 - protein, 106 aa, Homo sapiens
MSPQGQVLSAHVSGRVVMKSYLSGMPECKFGMNDKIVIEKQGKGTADETSKSGKQSIAIDDCTFHQCVRLSKFDSERSISFIPPDGEFELMRSHNQGHHPSLPNLS

SEQ ID NO: 759476 - protein, 222 aa, Homo sapiens
WDFGGATLGLPESCHPAAATMLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARGARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 759477 - protein, 113 aa, Homo sapiens
MGTHFLSPILILLLSRGPGSSDRQAWCGSRERAPRGQGTHRPRSQSPPRRLVPGPQDPVCPAARSLPVSDSVLSGFEQRVQEAHLTEDQIFYFPKYGFCEAADQFHVLDEVRR

SEQ ID NO: 759478 - protein, 139 aa, Homo sapiens
MGTHFLSPILILLLSRGPGSSDRQAWCGSRERAPRGQGTHRPRSQSPPRRLVPGPQDPVCPAARSLPVSDSVLSGFEQRVQEAHLTEDQIFYFPKYGFCEAADQFHVLDGECTAGQAWRRGEGGHCHRLSLVSAAEVRR

SEQ ID NO: 759479 - protein, 231 aa, Homo sapiens
WDFGGATLGLPESCHPAAATMLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARGARGAVHVVVAETDYQSFAVLYLERAGQLSVKLYGPQDPVCPAARSLPVSDSVLSGFEQRVQEAHLTEDQIFYFPKYGFCEAADQFHVLDEVRR

SEQ ID NO: 759480 - protein, 110 aa, Homo sapiens
MLSGLAFDWQGPRCCFSLTPLLCRKKVQRSAAYSPSALESAVPLHVDHQMPVQSHLPRGVPAGLAGHHMKHAGATHRPAMEVELLFCGANQNVNFFGCWVDRMRYSKPRV

SEQ ID NO: 759481 - protein, 214 aa, Homo sapiens
YGYEYLGNSPRLVITPLTDRCYRTLFGALHLHLGGAPEGPAGTGKTETTKDLAKAVAKQCVVFNCSDGLDYLALGKFFKGLLSCGAWACFDEFNRIDLEVLSVVAQQILTIQRGINAGADILMFEGTELKLDPTCAVFITMNPGYAGRSELPDNLKALFRTVAMMVPDYAMIAEIVLYSCGFVTARPLSVKIVATYRLCSEQLSSQHHYDYGMR

SEQ ID NO: 759482 - protein, 309 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 759483 - protein, 272 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQTMWRGPCLTPRRPSSTRARRAGRKS

SEQ ID NO: 759484 - protein, 296 aa, Homo sapiens
RLVRPELRDEGRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 759485 - protein, 301 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQVSAGPPCPPLQPTPAPRAALTSPFLPDTLPCRGGTKFSASGCFPEVLPRAPTQP

SEQ ID NO: 759486 - protein, 339 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQPQGAFLKSCPEPQPNPEEGALWSSGAPGPAGEMIDRIEYNVEHAVDYVERAVSDTKKAVKYQSKARRKKIMIIICCVILGIVIASTVGGIFA

SEQ ID NO: 759487 - protein, 137 aa, Homo sapiens
MFGMVAPVVLRSGKSDVISGLQSHPALAILPSMCHVGVTCPRCSIRQPAGEGYLLLLTTLGLLMGNVPPPQDPLPCGQAGRCMRVHAAGDGAVSVCPTLPRLYSCPVTVTTVRVAFLNSDSPQPLHQRSWYNQLPIL

SEQ ID NO: 759488 - protein, 137 aa, Homo sapiens; identical to SEQ ID NO: 759487

SEQ ID NO: 759489 - protein, 309 aa, Homo sapiens; identical to SEQ ID NO: 759482

SEQ ID NO: 759490 - protein, 301 aa, Homo sapiens; identical to SEQ ID NO: 759485

SEQ ID NO: 759491 - protein, 128 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSESGLSGGGWGAF

SEQ ID NO: 759492 - protein, 246 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGFSWEMCPRPRTLSLVDRQGDACECMQQGMGPCPCAPPSLGFTPAQ

SEQ ID NO: 759493 - protein, 312 aa, Homo sapiens
GGRRACGAHTAAAGAAATPGSMKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQVRPRSLGWAGTCVSGSVPAGPDPCTSISGPQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQPQGAFLKSCPEPQPNPEEGALWSSGAPGPAGRDD

SEQ ID NO: 759494 - protein, 381 aa, Homo sapiens
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 759495 - protein, 199 aa, Homo sapiens
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGTSGASRGRDLESASQEATGETQVSPRIMEHTFASTPAVFSFLGKYQPLELGQTQESVDTKLASRARLRTQEWH

SEQ ID NO: 759496 - protein, 458 aa, Homo sapiens
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 759497 - protein, 589 aa, Homo sapiens
GLFPVLWPFANKCLTRPALPPHSQPPSKSSMSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 759498 - protein, 589 aa, Homo sapiens; identical to SEQ ID NO: 759497

SEQ ID NO: 759499 - protein, 571 aa, Homo sapiens
GLFPVLWPFANKCLTRPALPPHSQPPSKSSMSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYAGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 759500 - protein, 553 aa, Homo sapiens
GLFPVLWPFANKCLTRPALPPHSQPPSKSSMSACRSFAVAICILEISILTAQYTTSYDPELTESSGSASHIDCRMSPWSEWSQCDPCLRQMFRSRSIEVFGQFNGCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYAGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 759501 - protein, 108 aa, Homo sapiens
LGGVFFFLFVSGCWKTPSLRVRFQNPTASQGQGNGAASPTKKKVVAKAKAPKAGQGPNTKAAAPAKGSGSKVVPAHLSRKTEAPKGPRKAGLPIKASSSKVSSQRAEA

SEQ ID NO: 759502 - protein, 68 aa, Homo sapiens
PGQEGCGFHTLVLVRASHLPHLGGPSVSAAAWARQGAACLCWSCLEGGLGGERRTTDLNHSSCEMLEV

SEQ ID NO: 759503 - protein, 153 aa, Homo sapiens
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIRRWW

SEQ ID NO: 759504 - protein, 307 aa, Homo sapiens
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKEISPSGR

SEQ ID NO: 759505 - protein, 131 aa, Homo sapiens
MPNIPGDLESREAMVAFFNSAGASAQEEQRVCCQPLAHPVASSQKKPEVAAPAPESGGESVFGETHRALQGAMEKLQESTSARGQCQRRSTGRGGHRQAGPGPGGDEGEPAGAAGQVLQLVGDHKEGHGKF

SEQ ID NO: 759506 - protein, 186 aa, Homo sapiens
MAGPGHPDAGLGRPGRHREGRDGRPRPSAVPATPQGGCQSLSPAPSSENIPAPHPPPPPAASAPCQAPPVTPGGSHPGEGVCHLPPGHSSGHPGWGILGPWGAVFGTCVRQGCSDNQVSSTGGGMGMVTVVLLMSPMMLSASFSAWCMCSISSCCCACSANSSISVFWFPHEYILASGSEMMNSGV

SEQ ID NO: 759507 - protein, 186 aa, Homo sapiens; identical to SEQ ID NO: 759506

SEQ ID NO: 759508 - protein, 147 aa, Homo sapiens
MLTRTQRHLHQLPAHSCLACSEDHPSCSGRQGLLTNVRLSFLHLRAFHGSLLPTALNPNKSYSLDFEGSPPCALDLEPLGVWLFTRASIPLRLEDPPPHCLFSLRWGHRGPEEKTPVKCHRSGRGLKTYHAKRTPVYSVFFWWGGGR

SEQ ID NO: 759509 - protein, 129 aa, Homo sapiens [sequence omitted]

SEQ ID NO: 759510 - protein, 186 aa, Homo sapiens; identical to SEQ ID NO: 759506

SEQ ID NO: 759511 - protein, 186 aa, Homo sapiens; identical to SEQ ID NO: 759506

SEQ ID NO: 759512 - protein, 70 aa, Homo sapiens
QRVCCQPLAHPVASSQKKPEVAAPAPESGGESVFGETHRALQGAMEKLQVSRSWHGPTRGAGGQDKAGDS

SEQ ID NO: 759513 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 759514 - protein, 614 aa, Homo sapiens
YRNQITIARDYKAQHNALLCQRVTMTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 759515 - protein, 114 aa, Homo sapiens
SETGTAASKHDIQGHLEAGFGPWFVSLTHSFNNCLLCVYWVPDTGLRHRAPSRKPNGQPPALVDCIFLLQWSCLYSAKMDFVPRYLCPPSCKGVQIKQLGKKGGRDEGTGRSLV

SEQ ID NO: 759516 - protein, 1358 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759517 - protein, 280 aa, Homo sapiens
RLGRAWVVNSPRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLKTADQESRGAARLE

SEQ ID NO: 759518 - protein, 223 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSGAAKPHIFETQKLDLMTEVSELKLKLVGMEKEQREQEEKQKKQRSYCKSSGTSEIKVEELENERNQYEWKLKATKAEVAQLQEQVALKDAEIERLHSQLSRTAALHSESHTERDQE

SEQ ID NO: 759519 - protein, 1370 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEEIIEMHSLFWILGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759520 - protein, 962 aa, Homo sapiens
DGPWVGENSCNEGHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759521 - protein, 1358 aa, Homo sapiens; identical to SEQ ID NO: 759516

SEQ ID NO: 759522 - protein, 630 aa, Homo sapiens
MKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759523 - protein, 569 aa, Homo sapiens
LYSDWSLHTGTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759524 - protein, 562 aa, Homo sapiens [sequence omitted]

SEQ ID NO: 759525 - protein, 1156 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQLSSGGLLPSHPTTSPS

SEQ ID NO: 759526 - protein, 1004 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYH

SEQ ID NO: 759527 - protein, 1014 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTNDPVPHSDRTKQEAGGLHVHCQPMDLYIRRIG

SEQ ID NO: 759528 - protein, 1378 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARVIMKIKSLMSVPAHAECYVRDHLLHHWIALLADCPITAHMYEDVALIKDHTLVNSLIRVLQTLQEFNITLETSLVKGIDI

SEQ ID NO: 759529 - protein, 1312 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDEITSYTTGLPCWLTAPSLHTCMRMWH

SEQ ID NO: 759530 - protein, 1359 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDEITSYTTGLPCWTDQRPYTCQFLDSCAADIAGVQHHAGDVPCQGHRHLTSQHQPAAGLRKTHPAALTFFPKGT

SEQ ID NO: 759531 - protein, 1004 aa, Homo sapiens; identical to SEQ ID NO: 759526

SEQ ID NO: 759532 - protein, 1358 aa, Homo sapiens; identical to SEQ ID NO: 759516

SEQ ID NO: 759533 - protein, 313 aa, Homo sapiens
SKVISSTFLGICMICVSPNSPDIQILGCQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759534 - protein, 318 aa, Homo sapiens
MGPSQGCEEEGYVQHVGSEGQGHRAHTHTLGTGEGSLLSTDTKEFKQSPPGTVLQNGESDHSRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759535 - protein, 159 aa, Homo sapiens
MRGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 759536 - protein, 1212 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKEVSLPALQSRALH

SEQ ID NO: 759537 - protein, 735 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAVCICVRLLLDSLFCFIDLLVYIYTNTTLS

SEQ ID NO: 759538 - protein, 728 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAGKASLEMYIQASWIMALTCPFS

SEQ ID NO: 759539 - protein, 416 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQRKSVLTRAFCLPQASLLSMFRYSEADCKG

SEQ ID NO: 759540 - protein, 636 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNRERHMRWGSSRSTAGSK

SEQ ID NO: 759541 - protein, 686 aa, Homo sapiens
IGIPASDGRPVPPRPVTAPRRPRGPARAGGGGPSRGSGGGGRGGLRADGRAPGLRGLGAAPHCPAGLGPGAMSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLHA

SEQ ID NO: 759542 - protein, 598 aa, Homo sapiens
EKTSDSSHRPSRHGFLFLRLVGLSPFSYLCVPPSRPVPGSPRSLSAMRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 759543 - protein, 4357 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEVLDWPTWHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAA

SEQ ID NO: 759544 - protein, 74 aa, Homo sapiens
AAAYYYYCSEFKLLTMYGLEAVLPACESGVEDDQMAQVFIFKIIRRCFPYLQNDSPKSVLNSLFSCKCVFYSIA

SEQ ID NO: 759545 - protein, 3756 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQVTFWCF

SEQ ID NO: 759546 - protein, 4330 aa, Homo sapiens
GPKFATHGVKETLRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINN

SEQ ID NO: 759547 - protein, 3160 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLFAVTWRHTITDAAEMEEGFSESPDNLDHTENAASGSGPSARGRSAVTRRHKFDLAARTLLARAAGLYRSVQAHRNQSRREGISLQQDPGALYDFNLDEEVESD

SEQ ID NO: 759548 - protein, 2672 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQGMLSDFFFFCFCAVEIIFIIVRSDTFCK

SEQ ID NO: 759549 - protein, 1728 aa, Homo sapiens
VIQRIPVARCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 759550 - protein, 1289 aa, Homo sapiens [sequence omitted]

SEQ ID NO: 759551 - protein, 890 aa, Homo sapiens [sequence omitted]

SEQ ID NO: 759552 - protein, 859 aa, Homo sapiens
HNVCPALSKHSGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 759553 - protein, 4368 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVR

SEQ ID NO: 759554 - protein, 4368 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCH

SEQ ID NO: 759555 - protein, 3914 aa, Homo sapiens
ACMIVGGIDKHLVFIDATLLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGAKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 759556 - protein, 2862 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRQELKTILRQIFALMMSEIRELFYFGSSFRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNWDPTGHILMTCAKEDSVKLWGSISGCWCCLHSLCHPSIVNGIAWCRLPGKGSKLQLLMATGCQSGLVCVWRIPQDTTQTNVTSAEGWWDQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 759557 - protein, 1332 aa, Homo sapiens
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRYQPGKHLSEVYRCVYKVRSRLLACKNLELIQTRSSSRDRWVKFEIN

SEQ ID NO: 759558 - protein, 1060 aa, Homo sapiens [sequence omitted]

SEQ ID NO: 759559 - protein, 67 aa, Homo sapiens
GSDGHSMALTESGEVFSWGDGDYGKLGHGNSDRQRRPRQIEALQGEEVVQVRQEMDKFAFHCKYTSC

SEQ ID NO: 759560 - protein, 70 aa, Homo sapiens
PITRLSPDVGNPNAVGLHFSSSFHWLPTDPPETPDLYRAIHGSCPGTESKISLEKHFSSLQDPVARSFLH

SEQ ID NO: 759561 - protein, 266 aa, Homo sapiens
AGAESGPQRALSSPTAAAGLVTITPREEPQLPQPAPVTITATMSSEAETQQPPATHPRPALSAADTKPGTTGSGAGSGGPGGLTSAAPAGGHKKVIATKVLGTVKWFNVRNGYGFIHRNDTKEDVFVHQGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGDETQGQQPPQRRYRRNFNYRRRRPENPK

SEQ ID NO: 759562 - protein, 55 aa, Homo sapiens
RPQYSNPPVQGEVMEGADNQGAGEQGRPVRQNMYRGYRPRFRRGPPLQRQPREDG

SEQ ID NO: 759563 - protein, 180 aa, Homo sapiens [sequence omitted]

SEQ ID NO: 759564 - protein, 194 aa, Homo sapiens [sequence omitted]

SEQ ID NO: 759565 - protein, 183 aa, Homo sapiens
MAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRSGG

SEQ ID NO: 759566 - protein, 206 aa, Homo sapiens
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFWYQDDAGLIK

SEQ ID NO: 759567 - protein, 356 aa, Homo sapiens
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 759568 - protein, 356 aa, Homo sapiens; identical to SEQ ID NO: 759567

SEQ ID NO: 759569 - protein, 240 aa, Homo sapiens
MVNEYKNSTVIATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 759570 - protein, 134 aa, Homo sapiens
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQQPHSSCH

SEQ ID NO: 759571 - protein, 193 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGPSLFLTTQDIHLGVNESLTDTARVLSSMADAVLARVYKQSDLDTLAKEAIPNINGLSELYHIQILADYLAQEHYSSLKGLTLSWIGD

SEQ ID NO: 759572 - protein, 175 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEGPSLFLTTQDIHLGVNESLTDTARVLSSMADAVLARVYKQSDLDTLAKEAIPNINGLSELYHIQILADYLAQEHYSSLKGLTLSWIGD

SEQ ID NO: 759573 - protein, 586 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 759574 - protein, 533 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQRRCLALLPWLFSNSWPQVILPPWLPSG

SEQ ID NO: 759575 - protein, 530 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPHLAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 759576 - protein, 330 aa, Homo sapiens
LQTLPTPFIRPCTQQRQLTWSVTVTYVHPGPNKCYVLSPIHIERRAEGEVYCVPSTHCSITPATLRAILVRRVRSMARLYYRHIYDPLPDNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 759577 - protein, 520 aa, Homo sapiens
EGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLAREPEEINADDEIEDTCDHKEDDLGAVEEQRSVILHLLSQLKLGMDLTRVVLPTFILEKRSLLEMYADFMSHPDLFIAITNGATAEDRMIRFVEYYLTSFHEGRKGAIAKKPYNPIIGETFHCSWKMPKSEVASSVFSSSSTQGVTNHAPLSGESLTQVGSDCYTVRFVAEQVSHHPPVSGFYAECTERKMCVNAHVWTKSKFLGMSIGVTMVGEGILSLLEHGEEYTFSLPCAYARSILTVPWVELGGKVSVNCAKTGYSASITFHTKPFYGGKLHRVTAEVKHNITNTVVCRVQGEWNSVLEFTYSNGETKYVDLTKLAVTKKRVRPLEKQDPFESRRLWKNVTDSLRESEIDKATEHKHTLEERQRTEERHRTETGTPWKTKYFIKEGDGWVYHKPLWKIIPTTQPAE

SEQ ID NO: 759578 - protein, 120 aa, Homo sapiens
CARSAVPLFGGAEAGSSNGETKYVDLTKLAVTKKRVRPLEKQDPFESRRLWKNVTDSLRESEIDKATEHKHTLEERQRTEERHRTETGTPWKTKYFIKEGDGWVYHKPLWKIIPTTQPAE

SEQ ID NO: 759579 - protein, 520 aa, Homo sapiens; identical to SEQ ID NO: 759577

SEQ ID NO: 759580 - protein, 392 aa, Homo sapiens
EGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLAREPEEINADDEIEDTCDHKEDDLGAVEEQRSVILHLLSQLKLGMDLTRVVLPTFILEKRSLLEMYADFMSHPDLFIAITNGATAEDRMIRFVEYYLTSFHEGRKGAIAKKPYNPIIGETFHCSWKMPKSEVASSVFSSSSTQGVTNHAPLSGESLTQVGSDCYTVRFVAEQVSHHPPVSGFYAECTERKMCVNAHVWTKSKFLGMSIGVTMVGEGILSLLEHGEEYTFSLPCAYARSILTVPWVELGGKVSVNCAKTGYSASITFHTKPFYGGKLHRAISSP

SEQ ID NO: 759581 - protein, 114 aa, Homo sapiens
ESQELLRRSHCLHATCFDDPALPSLCSKGRALPLPVPDGSQGDAGQQVCMARPGHQGPDSMAASFILSLFVPLARLMRFLEDKTPSCHLVCFLNIHCTSTAPGRSPWESGRRPW

SEQ ID NO: 759582 - protein, 794 aa, Homo sapiens
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 759583 - protein, 208 aa, Homo sapiens
MQAGFGRQPNRPCLDKTWSDESKILSAMGHPVESSIWPRASPPFKCTYVLPLTSPFNVTCFSKSPGANNPGSSNPSYWGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLGWFQY

SEQ ID NO: 759584 - protein, 346 aa, Homo sapiens
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKVYRQMLGQLTTK

SEQ ID NO: 759585 - protein, 794 aa, Homo sapiens; identical to SEQ ID NO: 759582

SEQ ID NO: 759586 - protein, 637 aa, Homo sapiens [sequence omitted]

SEQ ID NO: 759587 - protein, 300 aa, Homo sapiens
LFITHKKRTSRIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 759588 - protein, 118 aa, Homo sapiens
KLPTKLLPTQRTPGPPLPPEGLRLPVTLRPTSRRYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759589 - protein, 872 aa, Homo sapiens
EVGRSRPRRRRGYIPRSRPRSARAVCGPCRVQGSRPAGAGSEAAEEPGEEEPGRQLVGSPAWVPESCEKEMRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759590 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759591 - protein, 832 aa, Homo sapiens
EVGRSRPRRRRGYIPRSRPRSARAVCGPCRVQGSRPAGAGSEAAEEPGEEEPGRQLVGSPAWVPESCEKEMRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759592 - protein, 266 aa, Homo sapiens
EVGRSRPRRRRGYIPRSRPRSARAVCGPCRVQGSRPAGAGSEAAEEPGEEEPGRQLVGSPAWVPESCEKEMRLLLALLGVLLSVPGPPVLSLEASEEVELDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSRTGPSEAGSGTHSVVGASDCFMVRIRPFVVSLLRRVSGP

SEQ ID NO: 759593 - protein, 247 aa, Homo sapiens
EVGRSRPRRRRGYIPRSRPRSARAVCGPCRVQGSRPAGAGSEAAEEPGEEEPGRQLVGSPAWVPESCEKEMRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGEQHSGRDVSLRGLRLCSQLLSLSGLEAIQRYSKDSGLLTVIQAENGKSNFLSLLCGLGF

SEQ ID NO: 759594 - protein, 839 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQGQWSPRTCVPAAAHLITEKRRPVWEHTVILGAFPCPPAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759595 - protein, 713 aa, Homo sapiens
MRTPSPIGTSRIGTVTPSKVSRSPRTCVPAAAHLITEKRRPVWEHTVILGAFPCPPAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759596 - protein, 692 aa, Homo sapiens
MLPSVPDVDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759597 - protein, 788 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759598 - protein, 762 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759599 - protein, 454 aa, Homo sapiens
MVQRLGVNRPSAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759600 - protein, 376 aa, Homo sapiens
MYEAGCESAEGLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 759601 - protein, 449 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARSSPWSQALPASQAHPWYEACVSPPAAPPCSPAS

SEQ ID NO: 759602 - protein, 902 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEASGWDRTAQPGQLFMEAIGIAPVCPQGVVAENAYAVRGVRQRDWRLGPPWKTERQLMIVYPHSGLLPALSIASPADGIPHRTHLTPRTVPPPGQEPGSHLTTSLKNPVPGQVRQLTPVIPALWETEAGGSPEVKNSRPFWTTWQNPVST

SEQ ID NO: 759603 - protein, 583 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVGLYARPDRASSAVLARLCEAKLPHLCKPPFPLV

SEQ ID NO: 759604 - protein, 206 aa, Homo sapiens
MLPSVPDVDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVSRGVGPRFPWQAKRDSCPGGRREGGEGP

SEQ ID NO: 759605 - protein, 163 aa, Homo sapiens
EVGRSRPRRRRGYIPRSRPRSARAVCGPCRVQGSRPAGAGSEAAEEPGEEEPGRQLVGSPAWVPESCEKEMRLLLALLGVLLSVPGPPVLSLEASEEVELGMASEVGEGGRGGKSGHQEGAAGLSKAGKDPCPGPEKVAAGQGSTTETQSVPGFPRLDGSIGP

SEQ ID NO: 759606 - protein, 244 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 759607 - protein, 167 aa, Homo sapiens
MIITTWIVYILARKGVGLPFLPITSSDIDVVESEAVSVLHHWLKKTEEEASRGIKEKLSINHPSQGVREKMSTDSPPTHGQDIHVTRDVVKHHLSKSDLLANQSQEVLEERTRIQFIRWSHTRIFQVPSEMTEDIMRDRIEQVRRSISRLTDVSAQDFSMRPSSSDC

SEQ ID NO: 759608 - protein, 167 aa, Homo sapiens; identical to SEQ ID NO: 759607

SEQ ID NO: 759609 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 759610 - protein, 46 aa, Homo sapiens
LSRNPRTSPPCNHQRVTGTGGSSTHTVEESVLIVKALNPLNTEYFE

SEQ ID NO: 759611 - protein, 629 aa, Homo sapiens
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKLGCKQFVTPADVVSGNPKLNLAFVANLFNTYPCLHKPNNNDIDMNLLEGESKEERTFRNWMNSLGVNPYINHLYSDLADALVIFQLYEMIRVPVNWSHVNKPPYPALGGNMKKIENCNYAVELGKNKAKFSLVGIAGQDLNEGNSTLTLALVWQLMRRYTLNVLSDLGEGEKVNDEIIIKWVNQTLKSANKKTSISSFKDKSISTSLPVLDLIDAIAPNAVRQEMIRRENLSDEDKLNNAKYAISVARKIGARIYALPDDLVEVKPKMVMTVFACLMGKGLNRIK

SEQ ID NO: 759612 - protein, 138 aa, Homo sapiens
LKRAGLMLKKQITGRQTVCYSADGVQANPKLNLACVANLFNTYPCLHKPNNNDIDMNLLEGESKEERTFRNWMNSLGVNPYINHLYSDLADALVIFQLYEMIRVPVNWSHVNKPPYPALGGNMKKVNEIMAMDILLLF

SEQ ID NO: 759613 - protein, 629 aa, Homo sapiens; identical to SEQ ID NO: 759611

SEQ ID NO: 759614 - protein, 629 aa, Homo sapiens; identical to SEQ ID NO: 759611

SEQ ID NO: 759615 - protein, 629 aa, Homo sapiens; identical to SEQ ID NO: 759611

SEQ ID NO: 759616 - protein, 127 aa, Homo sapiens
APIGQRNASRHNGAGRRRRAGQRRGFPLSPQPPAAGKVRARGRSLPARSGPGARRGERGRPGLESRRILRVKTPTGSSLCFQLPTRPHYLDGPQVIVNLFCEKSEGDLFNAFFLRIFQIETNCRGSS

SEQ ID NO: 759617 - protein, 87 aa, Homo sapiens
APIGQRNASRHNGAGRRRRAGQRRGFPLSPQPPAAGKVRARGRSLPARSGPGARRGERGRPGLESRRMKTNTEMVCLRNFKRCRPPD

SEQ ID NO: 759618 - protein, 67 aa, Homo sapiens
APIGQRNASRHNGAGRRRRAGQRRGFPLSPQPPAAGKVRARGRSLPARSGPGARRGERGRPGLESRR

SEQ ID NO: 759619 - protein, 86 aa, Homo sapiens
APIGQRNASRHNGAGRRRRAGQRRGFPLSPQPPAAGKVRARGRSLPARSGPGARRGERGRPGLESRRAPVCVFSCLLDLTTWMAHR

SEQ ID NO: 759620 - protein, 108 aa, Homo sapiens
APIGQRNASRHNGAGRRRRAGQRRGFPLSPQPPAAGKVRARGRSLPARSGPGARRGERGRPGLESRRILRVKTPTVIVNLFCEKSEGDLFNAFFLRIFQIETNCRGSS

SEQ ID NO: 759621 - protein, 116 aa, Homo sapiens
APIGQRNASRHNGAGRRRRAGQRRGFPLSPQPPAAGKVRARGRSLPARSGPGARRGERGRPGLESRRILRVKTPTGSSLCFQLPTRPHYLDGPQLWRLEGPRSRYYRFDFWTLNMV

SEQ ID NO: 759622 - protein, 104 aa, Homo sapiens
APIGQRNASRHNGAGRRRRAGQRRGFPLSPQPPAAGKVRARGRSLPARSGPGARRGERGRPGLESRRAPVCVFSCLLDLTTWMAHSSGDWKVQDQDTTDLISGR

SEQ ID NO: 759623 - protein, 655 aa, Homo sapiens
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQEFQRLLKELPECNYLLISWLIVHMDHVIAKELETKMNIQNISIVLSPTVQISNRVLYVFFTHVQELFGNVVLKQVMKPLRWSNMATMPTLPETQAGIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 759624 - protein, 215 aa, Homo sapiens
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHNKQAQPAQHNRATHRPQHTRTPGGGRVPIGLRERITITGADKRVMGKRGTIMAGRSLGWYKKRGWSNDRRRMKK

SEQ ID NO: 759625 - protein, 655 aa, Homo sapiens; identical to SEQ ID NO: 759623

SEQ ID NO: 759626 - protein, 655 aa, Homo sapiens; identical to SEQ ID NO: 759623

SEQ ID NO: 759627 - protein, 655 aa, Homo sapiens; identical to SEQ ID NO: 759623

SEQ ID NO: 759628 - protein, 655 aa, Homo sapiens; identical to SEQ ID NO: 759623

SEQ ID NO: 759629 - protein, 572 aa, Homo sapiens
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQEFQRLLKELPECNYLLISWLIVHMDHVIAKELETKMNIQNISIVLSPTVQISNRVLYVFFTHVQELFGNVVLKQVMKPLRWSNMATMPTLPETQAGIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQMSFPDSVSLFED

SEQ ID NO: 759630 - protein, 655 aa, Homo sapiens; identical to SEQ ID NO: 759623

SEQ ID NO: 759631 - protein, 266 aa, Homo sapiens
MIRLHCLPIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 759632 - protein, 111 aa, Homo sapiens
MRSARPSSSCACSCGCSRCSEPRPSSRRRRTRSLSGAGVPSSRPETASLSQKQLKSSQRQARSRQSHRPAGIGRRRPSEQPAWPSGVRETERTRASYCNPGARPALSLYIL

SEQ ID NO: 759633 - protein, 655 aa, Homo sapiens; identical to SEQ ID NO: 759623

SEQ ID NO: 759634 - protein, 137 aa, Homo sapiens
GRVGRPTRRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 759635 - protein, 129 aa, Homo sapiens
MRSARPSSSCACSCGCSRCSEPRPSSRRRRTRSLSGAGVPSSRPETASLSQKQLKSSQRQARSRQSHRPAGIGRRRPSEQPAWSSGEEAARSCQFLTAGTSKGLLTGLVKGSHLGLVHPQRMLFKPEIF

SEQ ID NO: 759636 - protein, 655 aa, Homo sapiens; identical to SEQ ID NO: 759623

SEQ ID NO: 759637 - protein, 386 aa, Homo sapiens
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVTISFVYIVTAVVGVEAWYEPFLFNFLYRDLFTAMIIGCALCVTLPMSLLNFFRSYKNNTLKLNSVYEAMVPLFSPCLLFILSTAWILWSPSDILELHPRVFYFMVGTAFANSTCQLIVCQMSSTRCPTLNWLLVPLFLVVLVVNLGVASYVESILLYTLTTAFTLAHIHYGVRVVKQLSSHFQIYPFSLRKPNSD

SEQ ID NO: 759638 - protein, 186 aa, Homo sapiens
MHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVVSMCSTLNFQYYHDTFGKLLSLLIYCS

SEQ ID NO: 759639 - protein, 119 aa, Homo sapiens
AWLRAGWRAFLRRSCGSWGLGVGERGSILSPPPVVGTPREISFSLGERSVIMERGNSLPIFFKLIIFVSPRKDGVPSVVSIAFILVKFPLACHAYNFGGGDDRLADEAREGSDLPMPSC

SEQ ID NO: 759640 - protein, 110 aa, Homo sapiens
MRPARRRGGRRQLLLRALDAVRHLLGEALRAARPGLQGLLARPVLALRGEENQRGRGRAWRRASFCRLVGDLGPSLDAARAPRRAQDLEKGARLAAAGSRRRPALHAPKA

SEQ ID NO: 759641 - protein, 103 aa, Homo sapiens
QVPPKPALWALLLALLGTAPSRAYSPACSVPDVLRHYRAIIFEDLQAAVKWGGAGAEKTRPGSRHFHFIQKNLTRPGSSGRRGRPRASCGAQKVWRRRPYPSS

SEQ ID NO: 759642 - protein, 173 aa, Homo sapiens
SPGSPPGGPARAPPPASRGPTHHPPHRRRRLVRPAQPDQCRGGNGLGAGPIRAGGFLRRRPSPQLLDCSGAGGTNTWRFFRRGEDFLRAQRIHFLHINLSCWRDTAGKRRPIFVQRTLDLGRNKDDLDPCPHYLEFSMLAKIWTRAVPEGRGPWREAPVTAHPGVGLWALLLC

SEQ ID NO: 759643 - protein, 175 aa, Homo sapiens
FKPDSIRCCSLPWRLLLLCVRSTEISEFRNEWKNTHGGQEEKSPCYIPIVSSATLWDRSTPSAKHIPCYERTSVPCSRFINHMKNFSESPKFRSLHFLNFPGSHHGQATQKLQGAMVLHLEERRMMRRAKSKTTMKTPILFINCTNRLNNSHPNLQCTILVSFHYVMIINHITPK

SEQ ID NO: 759644 - protein, 175 aa, Homo sapiens
TQRECSSSRGGGCGRRPGIGTLQLQVDAGSAGLAPWQGEVEPDRLLSAAPRDSSRAREKRQHGSKGQGAEGVELVKLMSTVICMKQRDEEFLLTIRPFANRMQKSPCYIPIVSSATLWDRSTPSAKHIPCYERTSVPCSRFINHMKNFSESPKFRSLHFLNFPVFPEQDSKFNGV

SEQ ID NO: 759645 - protein, 139 aa, Homo sapiens
TQRECSSSRGGGCGRRPGIGTLQLQGVELVKLMSTVICMKQRDEEFLLTIRPFANRMQKSPCYIPIVSSATLWDRSTPSAKHIPCYERTSVPCSRFINHMKNFSESPKFRSLHFLNFPGSHHGQATQKLQGAMVLHLEE

SEQ ID NO: 759646 - protein, 167 aa, Homo sapiens
TQRECSSSRGGGCGRRPGIGTLQLQVDAGSAGLAPWQGEVEPDRLLSAAPRDSSRAREKRQHGSKGQGAEGVELVKLMSTVICMKQRDEEFLLTIRPFANRMQKSPCYIPIVSSATLWDRSTPSAKHIPCYERTSVPCSRFINHMKNFSESPKFRSLHFLNFPGPFH

SEQ ID NO: 759647 - protein, 136 aa, Homo sapiens
TQRECSSSRGGGCGRRPGIGTLQLQVDAGSAGLAPWQGEVEPDRLLSAAPRDSSRAREKRQHGSKGQGAEGVELVKLMSTVICMKQRDEEFLLTIRPFANRMQKSPCYIPIVSSATLWDRSTPSAKIKLLKLREVK

SEQ ID NO: 759648 - protein, 138 aa, Homo sapiens
TQRECSSSRGGGCGRRPGIGTLQLQVDAGSAGLAPWQGEVEPDRLLSAAPRDSSRAREKRQHGSKGQGAEGVELVKLMSTVICMKQRDEEFLLTIRPFANRMQKSPCYIPIVSSATLWDRSTPSAKPLVFIILECKQI

SEQ ID NO: 759649 - protein, 75 aa, Homo sapiens
LRRSFPGFSQSEGTASSHLVKPFQDLPVRGRLVLTVCRAPYSLSVGERVCELLSISSVICVLLEITDFVSYTLES

SEQ ID NO: 759650 - protein, 527 aa, Homo sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 759651 - protein, 708 aa, Homo sapiens
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 759652 - protein, 603 aa, Homo sapiens
MLPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 759653 - protein, 708 aa, Homo sapiens; identical to SEQ ID NO: 759651

SEQ ID NO: 759654 - protein, 708 aa, Homo sapiens; identical to SEQ ID NO: 759651

SEQ ID NO: 759655 - protein, 708 aa, Homo sapiens; identical to SEQ ID NO: 759651

SEQ ID NO: 759656 - protein, 131 aa, Homo sapiens
ANDFKNTVLHVLRKKTTLTDHIAIYLLSKTPLTYKHLKPGMLFFISQCNPSLSLRSRSIQYPIYLDDPESTKTLLFENKGFFVCLFVCLFVCFFLSVSLQESYNAGVKHYEADDFEMAIRHFEQALREYFV

SEQ ID NO: 759657 - protein, 119 aa, Homo sapiens
IISCIYQSPVHLLPQTHTHTHTHTHTIKLLQIQKLRENKLLGGETTTLTCAPVLKLTCAWSLKPFLALCLSATSLGANGHELRLSKVSSTLGLRSPWQSPRCLRYHGRNDHPGSGRSHG

SEQ ID NO: 759658 - protein, 1586 aa, Homo sapiens
MASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPADDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 759659 - protein, 131 aa, Homo sapiens
MIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIG

SEQ ID NO: 759660 - protein, 1281 aa, Homo sapiens
PEASDLFWKPGCCPPDREAPLHSDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 759661 - protein, 1281 aa, Homo sapiens; identical to SEQ ID NO: 759660

SEQ ID NO: 759662 - protein, 806 aa, Homo sapiens
GRGIHQTFAVDKDNNITDILDLTFTVNEEVFWTDWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 759663 - protein, 1052 aa, Homo sapiens
PEASDLFWKPGCCPPDREAPLHSDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEARVQWCDLGSLQPPPPRFKQFSCLSLSSSWDYRFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 759664 - protein, 164 aa, Homo sapiens
MVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 759665 - protein, 783 aa, Homo sapiens
PEASDLFWKPGCCPPDREAPLHSDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEVTLPTPRPTVHRSQSLPLPWEQNSSSVARI

SEQ ID NO: 759666 - protein, 83 aa, Homo sapiens
FFSLVCSQSFFVDHNSRATTFIDPRIPLQNGRLPNHLTHRQHLQRLRSYSAGEVTLPTPRPTVHRSQSLPLPWEQNSSSVARI

SEQ ID NO: 759667 - protein, 115 aa, Homo sapiens
NYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWV

SEQ ID NO: 759668 - protein, 88 aa, Homo sapiens
LRSDELVASLFRVIFCNRSPRVVLPVWLNFDGEPRQPYPTLPPGTGRRIHSYRGTGPALRPDPAGTIARSEAPLPPRGPFCRRGTEAP

SEQ ID NO: 759669 - protein, 141 aa, Homo sapiens
LRSDELVASLFRVIFCNRSPRVVLPVWLNFDGEPRQPYPTLPPGTGRRIHSYRGHLWLFRDAGTHDGLLVNQTELFVPSLNVDGQPIFANITLPVYTLKERCLQVVRSLVKPENYRRLDIVRSLYEDLGRPPKCAERPGSG

SEQ ID NO: 759670 - protein, 117 aa, Homo sapiens
LRSDELVASLFRVIFCNRSPRVVLPVWLNFDGEPRQPYPTLPPGTGRRIHSYRVYTLKERCLQVVRSLVKPENYRRLDIVRSLYEDLEDHPNVQKDLGAADTGAHCTSTDGEIEDFC

SEQ ID NO: 759671 - protein, 103 aa, Homo sapiens
KNPVKKIVYGKACALKRKMEACPVFPLPGLFSTIPQLPHNTVTSGISTHFSKVNSNFFPYITLYKAFLEILHQTKLLCISTSITAFTFYIEIISWYVCLHEAN

SEQ ID NO: 759672 - protein, 40 aa, Homo sapiens
TGGSLEGQGACPILFTSASPHRPNARADAFKKCLQKEEMK

SEQ ID NO: 759673 - protein, 1186 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759674 - protein, 1186 aa, Homo sapiens; identical to SEQ ID NO: 759673

SEQ ID NO: 759675 - protein, 1159 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759676 - protein, 1186 aa, Homo sapiens; identical to SEQ ID NO: 759673

SEQ ID NO: 759677 - protein, 1040 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759678 - protein, 1090 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759679 - protein, 997 aa, Homo sapiens
MIFKHLLWREERWESSSCQVKSFGKQMNPAKMDQKEYSWVINGETVPGEHQGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759680 - protein, 640 aa, Homo sapiens
MPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759681 - protein, 606 aa, Homo sapiens
MWPVPFIAKRFAFFFIAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759682 - protein, 566 aa, Homo sapiens
VAEDHSQETPEPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759683 - protein, 484 aa, Homo sapiens
TQSPVGRHVVGVKGKGERERQREKIGGLKSIFILPLRPPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759684 - protein, 442 aa, Homo sapiens
AAAEQEGRRGVRPAQPPEPWASAAGAARWSPSAACSCGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759685 - protein, 196 aa, Homo sapiens
AAAYYYYRRGRVDPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759686 - protein, 225 aa, Homo sapiens
GRGARRAPRRAARAAPGAMGKCSGRCTLVAFCCLQLVAALERQIFDFLGYQWAPILANFLHIMAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 759687 - protein, 781 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGKNHYSN

SEQ ID NO: 759688 - protein, 225 aa, Homo sapiens; identical to SEQ ID NO: 759686

SEQ ID NO: 759689 - protein, 325 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSYRTPGIPDSAITQVFSKSRTIVNDGPVQA

SEQ ID NO: 759690 - protein, 216 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSGYQLDSI

SEQ ID NO: 759691 - protein, 130 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQQRSHHCTPA

SEQ ID NO: 759692 - protein, 78 aa, Homo sapiens
GRVGFFSKNTSLITRTLPPALTSLTPTLPQAPFYSTGVATGALKPFVFIRWFLQGDQVLFSLGPCKEGSALLVSVQAG

SEQ ID NO: 759693 - protein, 1209 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAGERTSEWTPARDLKVATDSEILKTVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759694 - protein, 1152 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759695 - protein, 1066 aa, Homo sapiens
MVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759696 - protein, 905 aa, Homo sapiens
MIFKHLLWREERWESRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759697 - protein, 441 aa, Homo sapiens
MPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 759698 - protein, 1186 aa, Homo sapiens; identical to SEQ ID NO: 759673

SEQ ID NO: 759699 - protein, 1135 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQHKALYLIGCFFIYVTISCVKKSLGRFCGQLGSPLGNPPGKKEFMSQGNKMLLTFHTDFSNEENGTIMFYKGFLAYYQAVDLDECASRSKSGEEDPQP

SEQ ID NO: 759700 - protein, 126 aa, Homo sapiens [sequence omitted]

SEQ ID NO: 759701 - protein, 1246 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 759702 - protein, 1148 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQVGDTTPFSLPGLWHS

SEQ ID NO: 759703 - protein, 1126 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKSEMLGRPFSSRGARRGREGQWSGSFLQPEGDHEVVVVVVRGLPQPKGDCEVEVVVRGLPQPEGGFWGREDLTPDLKICSLFRKDPPLAAVTTAVQELLRLAQAHPAGPPTLDPVNDLQLKDMSVVEGGLRARKLEELIQGAQCVHSPRFPAQYLKLRERMQIQKEMGKDETHR

SEQ ID NO: 759704 - protein, 1159 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQPLSSAAPLLTGRHRDRPDGVALLQYPAPLPASDLPNSRHATASRACAFLTVRNPSLAAASLQLPIHASYHACLPKPLSALHRCAPLRRRSHPLPRIALAPRRPGPWSPYGWHHCHSHRSQLYRFGLPLSTSHTPST

SEQ ID NO: 759705 - protein, 94 aa, Homo sapiens
SGWGRGARGQQCVQCPPFFLQVLRTLGYVDEAGTVKLAGRVACAMSSHELLLTELMFDNALSTLRPEEIAALLSGLVCQSPGDAGDQLPNTLKQ

SEQ ID NO: 759706 - protein, 1328 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKSEMLGRPFSSRGARRGREGQWSGSFLQPEGDHEVVVVVVRGLPQPKGDCEVEVVVRGLPQPEGGFWGREDLTPDLKICSLFRKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 759707 - protein, 1183 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMVST

SEQ ID NO: 759708 - protein, 169 aa, Homo sapiens
RRLTGGSLQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMVST

SEQ ID NO: 759709 - protein, 520 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 759710 - protein, 520 aa, Homo sapiens; identical to SEQ ID NO: 759709

SEQ ID NO: 759711 - protein, 520 aa, Homo sapiens; identical to SEQ ID NO: 759709

SEQ ID NO: 759712 - protein, 359 aa, Homo sapiens [sequence omitted]

SEQ ID NO: 759713 - protein, 139 aa, Homo sapiens
WLVRSAVIRMLQPRSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 759714 - protein, 528 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATVNILGLASHIWSLSHILLTFLR

SEQ ID NO: 759715 - protein, 445 aa, Homo sapiens [sequence omitted]

SEQ ID NO: 759716 - protein, 359 aa, Homo sapiens [sequence omitted]

SEQ ID NO: 759717 - protein, 520 aa, Homo sapiens; identical to SEQ ID NO: 759709

SEQ ID NO: 759718 - protein, 570 aa, Homo sapiens
PSRLPATLGGAGVGWVGGYKAGGEGEAPRTVLSWLTPFPLLPLGHACSFTMPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 759719 - protein, 545 aa, Homo sapiens
VTRGSTHASVLCCRSVTLALSPSFTMPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 759720 - protein, 502 aa, Homo sapiens
MPGSLPLNAEACWPKDVGIVALEIYFPSQYVDQAELEMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 759721 - protein, 214 aa, Homo sapiens
PSRLPATLGGAGVGWVGGYKAGGEGEAPRTVLSWLTPFPLLPLGHACSFTMPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGMLHAYSPPSPKIFF

SEQ ID NO: 759722 - protein, 520 aa, Homo sapiens; identical to SEQ ID NO: 759709

SEQ ID NO: 759723 - protein, 501 aa, Homo sapiens [sequence omitted]

SEQ ID NO: 759724 - protein, 397 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGKC

SEQ ID NO: 759725 - protein, 178 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGLLNTIIRTTLEAPSKNTSWV

SEQ ID NO: 759726 - protein, 179 aa, Homo sapiens
TFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTE

SEQ ID NO: 759727 - protein, 122 aa, Homo sapiens
PPRLMCSSRCAPSSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTE

SEQ ID NO: 759728 - protein, 760 aa, Homo sapiens
ANTAFLSMETFEPISQEPLSQASYDKAPDPVPELQDSFYAELQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGTPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 759729 - protein, 860 aa, Homo sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIVHNFGMNHDGIGNSCGRKVMKQQNYGSSHYCEYQSFFLVCLQSRLHHQLFREVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGGGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGKMPTRQPTQRARWRTKHILSYALCLLKKLIGNISCRFASSCNLAKETLL

SEQ ID NO: 759730 - protein, 571 aa, Homo sapiens
LEDPPTGRLYSWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIVHNFGMNHDGIGNSCGRKVMKQQNYGSSHYCEYQSFFLVCLQSRLHHQLFREVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDQIIRRYS

SEQ ID NO: 759731 - protein, 218 aa, Homo sapiens
LDQEVQLASPLRHMNRITCSLITVGLCRSKTIIKSNHLMSGTISVRTERQTRSLMTPLLFPPPQLNLHSSSTLFQEQQKMNMSQASVSFQDVTVEFTREEWQHLGPVERTLYRDVMLENYSHLISVGYCITKPKVISKLEKGEEPWSLEDEFLNQRYPGYFKVDHIKGIREKQEKLLWQEIFISDADKTLSKEGQKVLEKPFNLEIAPELSEKISCKC

SEQ ID NO: 759732 - protein, 145 aa, Homo sapiens
KEFLRLKIQYRSDLELHSITMKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 759733 - protein, 145 aa, Homo sapiens; identical to SEQ ID NO: 759732

SEQ ID NO: 759734 - protein, 145 aa, Homo sapiens; identical to SEQ ID NO: 759732

SEQ ID NO: 759735 - protein, 145 aa, Homo sapiens; identical to SEQ ID NO: 759732

SEQ ID NO: 759736 - protein, 145 aa, Homo sapiens; identical to SEQ ID NO: 759732

SEQ ID NO: 759737 - protein, 160 aa, Homo sapiens
AVSTATLRSRLGAPSSARAASRAGSRCVPFGWSAEEGRQLVRHSEATTGLPLPSPVCSLTQPPQQTTPRPGARVCGPLYRTWFWLWAPGPVAARGRREGRMRATGVRLACGTLLPQWSEEVRKRRSCLHGCGDNWAILTGLSTLPFFDRPVHTHQLLPRK

SEQ ID NO: 759738 - protein, 207 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 759739 - protein, 147 aa, Homo sapiens
MGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 759740 - protein, 167 aa, Homo sapiens
PPMDVTWQQAPKSSLVECFVCLCPSCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 759741 - protein, 207 aa, Homo sapiens; identical to SEQ ID NO: 759738

SEQ ID NO: 759742 - protein, 77 aa, Homo sapiens
QHRLVQAGCELVSWIDVYTRATCQPREVVVPLTVELMGTVAKQLVPSCVTVQRCGGCCPDDGLECVPTGQHQVRMQT

SEQ ID NO: 759743 - protein, 207 aa, Homo sapiens; identical to SEQ ID NO: 759738

SEQ ID NO: 759744 - protein, 188 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 759745 - protein, 207 aa, Homo sapiens; identical to SEQ ID NO: 759738

SEQ ID NO: 759746 - protein, 207 aa, Homo sapiens; identical to SEQ ID NO: 759738

SEQ ID NO: 759747 - protein, 207 aa, Homo sapiens; identical to SEQ ID NO: 759738

SEQ ID NO: 759748 - protein, 179 aa, Homo sapiens
MGSWHWEWYGAPTSTLSLGCLLLPGEKWTFLILPSHYGTTTHAHSLQGCVERQWQDSKQLAISPGPTLLRSEYVGSLSPVCSSLTQVHRVPWGQHRACPVMLLVFTKWLQRYLHFEKPAEPASVGQDPDFFGKSEGERATCLLSRSCLYLASVCNLRENDSCMGRSGGTGKSDLPGSCR

SEQ ID NO: 759749 - protein, 164 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759750 - protein, 248 aa, Homo sapiens
PAPARWPPRASLGSCRLPDPSPPATPLAAKRRGGARAAARSQHLCRLLRGRAASAVISNGILPLKCRGTARRGSWRPGGACARVASPPRAPGPWLLVEPSASFPVRGPGGPPFHHPFISLPASADSSSLVAASLAGVRKMATNFLAHEKIWFDKFKYDDAERRFYEQMNGPVAGASRQENGASVILRDIARARENIQKSLAGSSGPGASSGTSGHVSPMRQVEPPAKKPATPAEDDEDDDIDLFGSDN

SEQ ID NO: 759751 - protein, 101 aa, Homo sapiens
SGPYYYYIRGRVGIDDDGTMGSSLEGLVCALFQAGTGLVWGGLPKLAARGLPGIRKSYRFSVWVEDDKVGTDLLEEEITKFEEHSLRSHVQSVDIAAFNKI

SEQ ID NO: 759752 - protein, 183 aa, Homo sapiens
RLVEAGGVSWSRVLAGVRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759753 - protein, 146 aa, Homo sapiens
DAWVDPRVRLQLTDGGQGGGTAAGGSGYGKIRGETKGQESLQPGGQVLHPCVDVKALGIDDDGTMGSSLEGLVCALFQAGTGLVWGGLPKLAARGLPGIRKSYRFSVWVEDDKVGTDLLEEEITKFEEHSLRSHVQSVDIAAFNKI

SEQ ID NO: 759754 - protein, 149 aa, Homo sapiens
MRDAPLGQRTVQLTDGGQGGGTAAGGSGYGKIRGETKGQESLQPGGQVLHPCVDVKALGIDDDGTMGSSLEGLVCALFQAGTGLVWGGLPKLAARGLPGIRKSYRFSVWVEDDKVGTDLLEEEITKFEEHSLRSHVRWPNTCVAQRAEL

SEQ ID NO: 759755 - protein, 114 aa, Homo sapiens
MSPPWSRVLAGVRKMATNFLAHEKIWFDKFKYDDAERRFYWGLMTTGPWAQAWRALCALYSKLEPGWSGGGFPSWLPVGYRVSGKATDSVCWWRTTRWGQTCWRRRSPSLRSTV

SEQ ID NO: 759756 - protein, 188 aa, Homo sapiens
PAKYLRLGSEAGWRVAASLAGVRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759757 - protein, 163 aa, Homo sapiens
WLGRGWGVDSSSLVAASLAGVRKMATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759758 - protein, 140 aa, Homo sapiens
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759759 - protein, 173 aa, Homo sapiens
SCKAESHHSLRRVREKEKICLYGTEAHCKILLFSYRYVEFFFFHFSFTLISTGQFHISILHCLFLTILEVLLKGSVQFKHLAERKLTGGQDHVTQNRLIRRVLRGVVQELQQAISKLEARLNVLEKSSPGHRATAPQTQHVSPMRQVEPPAKKPATPAEDDEDDDIDLFGSDN

SEQ ID NO: 759760 - protein, 135 aa, Homo sapiens
MHYYEVVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPLEACHNRDPLDSQ

SEQ ID NO: 759761 - protein, 585 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPKYGETCWVGTQPGLWAQGQPSQAGAPPASSPAHLGWGLPETRGPSRVECRSRLSKGRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDN

SEQ ID NO: 759762 - protein, 164 aa, Homo sapiens; identical to SEQ ID NO: 759749

SEQ ID NO: 759763 - protein, 585 aa, Homo sapiens; identical to SEQ ID NO: 759761

SEQ ID NO: 759764 - protein, 585 aa, Homo sapiens; identical to SEQ ID NO: 759761

SEQ ID NO: 759765 - protein, 140 aa, Homo sapiens; identical to SEQ ID NO: 759758

SEQ ID NO: 759766 - protein, 585 aa, Homo sapiens; identical to SEQ ID NO: 759761

SEQ ID NO: 759767 - protein, 585 aa, Homo sapiens; identical to SEQ ID NO: 759761

SEQ ID NO: 759768 - protein, 585 aa, Homo sapiens; identical to SEQ ID NO: 759761

SEQ ID NO: 759769 - protein, 585 aa, Homo sapiens; identical to SEQ ID NO: 759761

SEQ ID NO: 759770 - protein, 585 aa, Homo sapiens; identical to SEQ ID NO: 759761

SEQ ID NO: 759771 - protein, 585 aa, Homo sapiens; identical to SEQ ID NO: 759761

SEQ ID NO: 759772 - protein, 585 aa, Homo sapiens; identical to SEQ ID NO: 759761

SEQ ID NO: 759773 - protein, 585 aa, Homo sapiens; identical to SEQ ID NO: 759761

SEQ ID NO: 759774 - protein, 585 aa, Homo sapiens; identical to SEQ ID NO: 759761

SEQ ID NO: 759775 - protein, 585 aa, Homo sapiens; identical to SEQ ID NO: 759761

SEQ ID NO: 759776 - protein, 585 aa, Homo sapiens; identical to SEQ ID NO: 759761

SEQ ID NO: 759777 - protein, 585 aa, Homo sapiens; identical to SEQ ID NO: 759761

SEQ ID NO: 759778 - protein, 364 aa, Homo sapiens [sequence omitted]

SEQ ID NO: 759779 - protein, 722 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPKYGETCWVGTQPGLWAQGQPSQAGAPPASSPAHLGWGLPETRGPSRVECRSRLSKGRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQMATNLAHEKIWFDKFKYDDAERRFYEQMNGPVGQLTDGGQGGGTAAGGSGYGKIRGETKGQESLQPGGQVLHPCVDVKALGIDDDGTMGSSLEGLVCALFQAGTGLVWGGLPKLAARGLPGIRKSYRFSVWVEDDKVGTDLLEEEITKFEEHVQSVDIAAFNKI

SEQ ID NO: 759780 - protein, 585 aa, Homo sapiens; identical to SEQ ID NO: 759761

SEQ ID NO: 759781 - protein, 585 aa, Homo sapiens; identical to SEQ ID NO: 759761

SEQ ID NO: 759782 - protein, 585 aa, Homo sapiens; identical to SEQ ID NO: 759761

SEQ ID NO: 759783 - protein, 585 aa, Homo sapiens; identical to SEQ ID NO: 759761

SEQ ID NO: 759784 - protein, 585 aa, Homo sapiens; identical to SEQ ID NO: 759761

SEQ ID NO: 759785 - protein, 140 aa, Homo sapiens; identical to SEQ ID NO: 759758

SEQ ID NO: 759786 - protein, 113 aa, Homo sapiens
LCSDPPLCSDESLQPGGQVLHPCVDVKALGIDDDGTMGSSLEGLVCALFQAGTGLVWGGLPKLAARGLPGIRKSYRFSVLVEDDKVGTDLLEEEITKFEEHVQSVDIAAFNKI

SEQ ID NO: 759787 - protein, 109 aa, Homo sapiens
MATNFLAHEKIWFDKFKYDDAERRFYEQMNGPVAGASRQENGASVILRDIARARENIQKSLAGSSGPGASSGTSGHVSPMRQVEPPAKKPATPAEDDEDDDIDLFGSDN

SEQ ID NO: 759788 - protein, 140 aa, Homo sapiens; identical to SEQ ID NO: 759758

SEQ ID NO: 759789 - protein, 585 aa, Homo sapiens; identical to SEQ ID NO: 759761

SEQ ID NO: 759790 - protein, 600 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPKYGETCWVGTQPGLWAQGQPSQAGAPPASSPAHLGWGLPETRGPSRVECRSRLSKGRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQTTDGRRTRRRHSCGRERLRPDTRSNEGPRKPATWWPSPPSLRGCQSLGD

SEQ ID NO: 759791 - protein, 364 aa, Homo sapiens [sequence omitted]

SEQ ID NO: 759792 - protein, 130 aa, Homo sapiens
GSTGCHLPEPFHQSSRVRRFLLLGRRVLGWRVSTAAPAGRSRARQRRPRGREGGRPGLRQKLAPLGTEAQVRQRGLRGRGPSAALGASAERRGDGGHVAGLEGVRGTGAPGALSHGASRSWKPLGQAAGA

SEQ ID NO: 759793 - protein, 130 aa, Homo sapiens; identical to SEQ ID NO: 759792

SEQ ID NO: 759794 - protein, 108 aa, Homo sapiens
MPAKNSMFHLEASECSARGAFPKVLPAWVERRQLSTPRGALEPALVLLGKDVRRGAKTHSHWCEGSALDRRLPPSGCRPGRWSQSRCPGATGSVCPQAPLDTPAEAAD

SEQ ID NO: 759795 - protein, 104 aa, Homo sapiens
MTTQKGDSTRARLATGPRPHRPSTYLPCAKWSPQPRSQPHQQRMTRMMTLTCLAVTTDGRRTRRRHSCGRERLRQDTRSNEGPRKPATWWPSPPSLLGCQSLGD

SEQ ID NO: 759796 - protein, 585 aa, Homo sapiens; identical to SEQ ID NO: 759761

SEQ ID NO: 759797 - protein, 585 aa, Homo sapiens; identical to SEQ ID NO: 759761

SEQ ID NO: 759798 - protein, 702 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPKYGETCWVGTQPGLWAQGQPSQAGAPPASSPAHLGWGLPETRGPSRVECRSRLSKGRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSGAATARYAEKRRAKKACNLVAKSSIPAWMSKPWGLMTTGPWAQAWRALCALYSKLEPGWSGGGFPSWLPVGYRVSGKATDSVCWWRTTRWGQTCWRRRSPSLRSTCRVSISQLSTRSEA

SEQ ID NO: 759799 - protein, 654 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPKYGETCWVGTQPGLWAQGQPSQAGAPPASSPAHLGWGLPETRGPSRVECRSRLSKGRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQESLQPGGQVLHPCVDVKALGIDDDGTMGSSLEGLVCALFQAGTGLVWGGLPKLAARGLPGIRKSYRFSVWVEDDKVGTDLLEEEITKFEEHVQSVDIAAFNKI

SEQ ID NO: 759800 - protein, 364 aa, Homo sapiens [sequence omitted]

SEQ ID NO: 759801 - protein, 702 aa, Homo sapiens; identical to SEQ ID NO: 759798

SEQ ID NO: 759802 - protein, 585 aa, Homo sapiens; identical to SEQ ID NO: 759761

SEQ ID NO: 759803 - protein, 364 aa, Homo sapiens [sequence omitted]

SEQ ID NO: 759804 - protein, 130 aa, Homo sapiens; identical to SEQ ID NO: 759792

SEQ ID NO: 759805 - protein, 116 aa, Homo sapiens
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSSHVPVHR

SEQ ID NO: 759806 - protein, 109 aa, Homo sapiens
SQALGDIDPSQRHVPFLLVERRCTSTCGPGIREEAYSLARLHTCTDSIYVFKGREMQSQARKSIHSFDTSRGVSGWKQNQTNLKVGECDALSSSSLLSSLPDASSLPFY

SEQ ID NO: 759807 - protein, 104 aa, Homo sapiens
PSPARLRSFCFSFPPTGQDCLACLCVVENSAVATPTSELPNFRELQSPRPTAREASCPDAMHPPVTSSRLSIPQDRKGSSSPREPRAVLGASGCRGKLRTLHSS

SEQ ID NO: 759808 - protein, 173 aa, Homo sapiens
ICCHEKREAAFAKHCCLKKLSSLRPILPLLVWVQLKATLRDLAVEIQGLPWGWQLRVQLELYLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVY

SEQ ID NO: 759809 - protein, 162 aa, Homo sapiens
MTILNIHEPNTGAPKFIKQLLVDIRNEIDSNTMIVGDFNTLLTALDRSSRQKVNKETLDLNYTLEQMDLTDIYRTFHPTTTEYTFYSTAHGIFSKIDHMIGHKMSLSKLKKIEIVSRTLSDHSGTKLKINSKRNLQNHANTWNLNNLLLNEHWVKNEIMVEM

SEQ ID NO: 759810 - protein, 476 aa, Homo sapiens
MKKIRTSLKGDLITVTNMGKALFGVQAFLGIEKRTVRNLMNGISVERPLGRNLIPVIGVLKVSVGAQTLLNTKESTLGKNLINVMSVGKPSVRAQILLYIRESIIGEKPYQCRHCSKSFSQRSDLVKHQRIHTGEKPYTCNQCNKHFSQSSDVKNIKESTLGRNHINVMCVGKPSVRAQILFCIRESILGRNHIHVISVAKVSVRIQTLLNIEGSTLERNPINVMSVGKLLIRAQSLFYIRGFILERNPIPVINVAKPSVGFQILLIINEFTLERSLTHVISAIKCLVEDEILLNITEFIQVRNPMNVMNVGKPLVRAPTLFFIRESTLERNLMHVVIVLKALVAVQILLSIKEYTLERNHMHVISVIKVLVKAQTSLNIREYTLVKSLIIAIVVRKPSVRVLTLFFIREFTLEKNYYLCTQCSKSFSQISDLIKHQRIHTGEKPYKCSECRKAFSQCSALSPTPENPHWEETKSM

SEQ ID NO: 759811 - protein, 367 aa, Homo sapiens
MILCSRLCLPQSASLRMEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSALAGRLFSTQERAAMQSHMERAVWAARRAAARGLRAVGAVVVDPASDRVLATGHDCSCADNPLLHAVMVCVDLVARGQGRGTYDFRPFPACSFAPAAAPQAVRAGAVRKLDADEDGLPYLCTGYDLYVTREPCAMCAMALVHARILRVFYGAPSPDGALGTRFRIHARPDLNHRFQVFRGVLEEQCRWLDPDT

SEQ ID NO: 759812 - protein, 191 aa, Homo sapiens
MILCSRLCLPQSASLRMEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSAPCCVCVPSVSRAGKLL

SEQ ID NO: 759813 - protein, 367 aa, Homo sapiens; identical to SEQ ID NO: 759811

SEQ ID NO: 759814 - protein, 292 aa, Homo sapiens
MILCSRLCLPQSASLRMEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPPLPVHWLRPVRDPRALRHVRHGPGARTHPARLLRCALARRRPGHPLPHPRTARPQPPLPGVPRGAGGAVPLAGPRHVGAALLPPDPSRSRPWGAPPGLPGLDFFRTSLTVDFRDTYRLQRGARVLPSVRIELSWTRSLGPPRASGALLRPPLLRLCPLCLAGR

SEQ ID NO: 759815 - protein, 125 aa, Homo sapiens
GQLRLWFGGVQVGWMPEMWEPEAWRSSAAGWTPTRRRRPPASGPFPLPAVGRPSWTSGPRFLPHKPDRGFQGHIPPPAGSTGAAFRADRAFLDSVIGATPCQRCPSAAALAAFVSPLSQRAGKLL

SEQ ID NO: 759816 - protein, 87 aa, Homo sapiens
DLLLLHCPSWTHTGKGFPGLPLGWRGRTQEDAVCSIHPLQSIFGGFADMQAAWGGGLSVGHPKRQLESGVRPGNGPEGMPAGSSCLL

SEQ ID NO: 759817 - protein, 65 aa, Homo sapiens
YSKFTETRKMFERSVHESGQNNRYSPKKEKAGGSEPQDEWGGSKSNRGSTDSLDSLSSRTEAVSP

SEQ ID NO: 759818 - protein, 120 aa, Homo sapiens
QDQRCRDRVQDLSWLRVEPTGLGVQAWASVEDQPLQLSTEAVEQVAHGSQLDSEPRSAPAARWSSQGHHPESLGLTLNSQQEGGVSASAPECRCSLLAREGLLCGQPEVGASGPAMAEPH

SEQ ID NO: 759819 - protein, 309 aa, Homo sapiens
MEPENDTGISEFVLLGLSEEPELQPFLFGLFLSMYLVTVLGNLLIILATISDSHLHTPMYFFLSNLSFADICFISTTIPKMLINIQTQSRVITYAGCITQMCFFVLFGGLDSLLLAVMAYDRFVAICHPLHYTVIMNPRLCGLLVLASWMIAALNSLSQSLMVLWLSFCTDLEIPHFFCELNQVIHLACSDTFLNDMGMYFAAGLLAGGPLVGILCSYSKIVSSIRAISSAQGKYKAFSTCASHLSVVSLFCCTGLGVYLTSAATHNSHTSATASVMYTVATPMLNPFIYSLRNKDIKRALKMSFRGKQ

SEQ ID NO: 759820 - protein, 311 aa, Homo sapiens
RGFKAPGASKSSLLPRMSVSQDPRKLCLMEEAVSEFEPGKATKSETQPQVSATVVLLPDGQASVVPHASENLASQVPQGHLQSMPTGNMQASQELCDLMSARRSNMGHKEPRNPNCQGSCKSQSPMFPPTHKRENSRKPNLEKHEEMFQGLRTPQLTPGRKTEDTRQNEGVQLLPSKKQPPSISHFGENIKQFFQTIFSKKERKPAPVTAESQKTVKNRSCVYGSSAEAERLMTAVGQILEENMSLCHARHASKVNQQRQQFQAPVCGFPCNHRHPFYSEHSRMLSYAASSQQATLKNQSRPNRDRQIRDQ

SEQ ID NO: 759821 - protein, 127 aa, Homo sapiens
ASVMPGDPPPTKLYHFRSTSDCCAGSENFKPMVLRFLGCVGVGPTKRDHLAPWLQPPFQGSERFHLTGVPGATGRKKLKAQQIYALSQGQERNSRTRSKRQIPSTSEFMTFLLAQVTFCLTAKSQCI

SEQ ID NO: 759822 - protein, 72 aa, Homo sapiens
KRAANRSIMLAKKIIIKDGGTPQGIGSPSVYHAVIVIFLEFFAWGLLTAPTLVVLHETFPKQQCVTVLIQQI

SEQ ID NO: 759823 - protein, 103 aa, Homo sapiens
SCRCSQEKQGLGEKSSSALMSLPLSTRPYQSAMTNHESLQSPCPHLLPQFPLCPASPHPTAPWLPPSLLHKMPLLNGLFPLGCIWKAKPPFESCLPLTWVTWR

SEQ ID NO: 759824 - protein, 74 aa, Homo sapiens
GLQAEGPWTDVISLASAESPTNPPCAHPPITESSCWRRQHETLKTSRSRRHRRQWPGWSWWRGYAITDFCLPAP

SEQ ID NO: 759825 - protein, 66 aa, Homo sapiens
NHIWEVLAYLSLKMMEQIGRDVEDSNKLLNKIGLIEARIGQYTMGPGAVAHTCNPSTLGGRGGWIT

SEQ ID NO: 759826 - protein, 149 aa, Homo sapiens
EVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVES

SEQ ID NO: 759827 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLACYCIGG

SEQ ID NO: 759828 - protein, 165 aa, Homo sapiens; identical to SEQ ID NO: 759827

SEQ ID NO: 759829 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 759830 - protein, 305 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 759831 - protein, 323 aa, Homo sapiens; identical to SEQ ID NO: 759829

SEQ ID NO: 759832 - protein, 173 aa, Homo sapiens
MEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 759833 - protein, 767 aa, Homo sapiens
MDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGESCCLAGMWPHEMPGDPSLPMESRLRPPALPDAQPRGLSPTLPAHRGIEEAMLRSEAGLGPADSNSPPLGTPCCELSHSVTSVTNLLCPRGSPHKREVLAVLVLPCWWPAGPGAGERNRWDEGDRACSCPEAQPCPSCHVLSTCMPLPDALLHSLVCPWGSWKASFFLPSTLTAPSPCGWTWASIQAYAWQAARGKCLLQRSSRTHVCRNGGCGTHRTRMEACDARWLLWLRGPAGHVSSVPF

SEQ ID NO: 759834 - protein, 526 aa, Homo sapiens
MDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 759835 - protein, 767 aa, Homo sapiens; identical to SEQ ID NO: 759833

SEQ ID NO: 759836 - protein, 767 aa, Homo sapiens; identical to SEQ ID NO: 759833

SEQ ID NO: 759837 - protein, 108 aa, Homo sapiens [sequence omitted]

SEQ ID NO: 759838 - protein, 239 aa, Homo sapiens
MVPPRGLKNKPEKSLVWPEAPSGPRHPEYTPLIALLSRSTFPPAVFNTTMHFLNYICIQDNKDTLFFLKSQKKKKKKKKPLRAPSGPQRSPFPQPTQSRWGQRAAPPQEGDTSRQHGWHIKAGVPPREEKPRGTRMNNRAPGGKLNHPQYKEKRPGGNTGERLLAQQTPRRWISPKHHQTGTSSQPAAPKAETATTTNKRPRPVVTHKRATGKTRHDYTRKTHTAAPRAHHAAQTHTHD

SEQ ID NO: 759839 - protein, 767 aa, Homo sapiens; identical to SEQ ID NO: 759833

SEQ ID NO: 759840 - protein, 239 aa, Homo sapiens; identical to SEQ ID NO: 759838

SEQ ID NO: 759841 - protein, 239 aa, Homo sapiens; identical to SEQ ID NO: 759838

SEQ ID NO: 759842 - protein, 767 aa, Homo sapiens; identical to SEQ ID NO: 759833

SEQ ID NO: 759843 - protein, 767 aa, Homo sapiens; identical to SEQ ID NO: 759833

SEQ ID NO: 759844 - protein, 239 aa, Homo sapiens; identical to SEQ ID NO: 759838

SEQ ID NO: 759845 - protein, 767 aa, Homo sapiens; identical to SEQ ID NO: 759833

SEQ ID NO: 759846 - protein, 239 aa, Homo sapiens; identical to SEQ ID NO: 759838

SEQ ID NO: 759847 - protein, 526 aa, Homo sapiens; identical to SEQ ID NO: 759834

SEQ ID NO: 759848 - protein, 526 aa, Homo sapiens; identical to SEQ ID NO: 759834

SEQ ID NO: 759849 - protein, 102 aa, Homo sapiens
VAAPALFAGCDVLIVRHRCRWARGSREGKEEGGRSGGGGGGAGGGGGGGGGGGEKLKLKQSQRRRGGVLGGAARAQKRWNPELRRLRLKTAGVAGPPPSPER

SEQ ID NO: 759850 - protein, 208 aa, Homo sapiens
FSFLNANPFSFFLSMSRNSLSIPVESLGHVYLMLMGSPFLGVGLTLVDSASVYPSCGLICMHESTVCIPLCFPQASLSCPFHFPCPIGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRGEA

SEQ ID NO: 759851 - protein, 102 aa, Homo sapiens; identical to SEQ ID NO: 759849

SEQ ID NO: 759852 - protein, 340 aa, Homo sapiens
KPLGRVHERRPESGSRGESGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759853 - protein, 423 aa, Homo sapiens
FSFLNANPFSFFLSMSRNSLSIPVESLGHVYLMLMGSPFLGVGLTLVDSASVYPSCGLICMHESTVCIPLCFPQASLSCPFHFPCPIGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759854 - protein, 548 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759855 - protein, 185 aa, Homo sapiens
MDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759856 - protein, 136 aa, Homo sapiens
LGAKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759857 - protein, 591 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTLPFGFSYLNVSISVFFFL

SEQ ID NO: 759858 - protein, 362 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRRAWCCS

SEQ ID NO: 759859 - protein, 430 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSSTSLWFFIFKCFNFCIFFSLREYLLISDVQGVATEKPLSSSVCRGVWPCGLGGAVILPLPRAGSRKSVLGVVGGQ

SEQ ID NO: 759860 - protein, 574 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759861 - protein, 266 aa, Homo sapiens
RGPRARDCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759862 - protein, 283 aa, Homo sapiens [sequence omitted]

SEQ ID NO: 759863 - protein, 547 aa, Homo sapiens
FSFLNANPFSFFLSMSRNSLSIPVESLGHVYLMLMGSPFLGVGLTLVDSASVYPSCGLICMHESTVCIPLCFPQASLSCPFHFPCPIGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRGEAVKALLERRAGALGMWREYCCLFFHRAVVGEEEAELKGRTLQAGAKSLEADGRVFTWDPEMFYLSSHVYLSGEWAFRRSSEGPIMSQKKGSQLEFVFQGVVGISVCPSCIIFLCDSTLGLLRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 759864 - protein, 557 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMYCKHLALSQPFSFTQQDMPKLRRQIYKELCHCKLTV

SEQ ID NO: 759865 - protein, 574 aa, Homo sapiens; identical to SEQ ID NO: 759860

SEQ ID NO: 759866 - protein, 421 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEK

SEQ ID NO: 759867 - protein, 155 aa, Homo sapiens
MKETIQGTGSWGPEPPGPGIPPAYSSPRRDVFVGPHLPNPDSSQVEGLGQILGQGLLSCTLPNGFGGQSGPEGERSLAPPDASILISNVCSIGDHVAQELFQGSDLGMAEEAERPGEKAGQHSPLREEHVTCVQIILPLPRAGSRKSVLGVVGGQ

SEQ ID NO: 759868 - protein, 103 aa, Homo sapiens
LFVTTLFHCAIFALFTLPRQPVSLALSDFLCLVSFGRSGDYRGVGLGALLSYLSLPYPGMGKMRTCHSVRPRTVLQNSESFPDGWRSRSLPAEVPSLPCWEDK

SEQ ID NO: 759869 - protein, 103 aa, Homo sapiens; identical to SEQ ID NO: 759868

SEQ ID NO: 759870 - protein, 103 aa, Homo sapiens; identical to SEQ ID NO: 759868

SEQ ID NO: 759871 - protein, 103 aa, Homo sapiens; identical to SEQ ID NO: 759868

SEQ ID NO: 759872 - protein, 103 aa, Homo sapiens; identical to SEQ ID NO: 759868

SEQ ID NO: 759873 - protein, 103 aa, Homo sapiens; identical to SEQ ID NO: 759868

SEQ ID NO: 759874 - protein, 103 aa, Homo sapiens; identical to SEQ ID NO: 759868

SEQ ID NO: 759875 - protein, 103 aa, Homo sapiens; identical to SEQ ID NO: 759868

SEQ ID NO: 759876 - protein, 237 aa, Homo sapiens
GGIGEGGAPPPRGWREGAQSQPRASKQPGGLASHPQPVRRSSCQRSRQRRHIPLWALNVTPRLDSPCPVKMLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 759877 - protein, 237 aa, Homo sapiens; identical to SEQ ID NO: 759876

SEQ ID NO: 759878 - protein, 237 aa, Homo sapiens; identical to SEQ ID NO: 759876

SEQ ID NO: 759879 - protein, 237 aa, Homo sapiens; identical to SEQ ID NO: 759876

SEQ ID NO: 759880 - protein, 167 aa, Homo sapiens
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 759881 - protein, 237 aa, Homo sapiens; identical to SEQ ID NO: 759876

SEQ ID NO: 759882 - protein, 237 aa, Homo sapiens; identical to SEQ ID NO: 759876

SEQ ID NO: 759883 - protein, 237 aa, Homo sapiens; identical to SEQ ID NO: 759876

SEQ ID NO: 759884 - protein, 237 aa, Homo sapiens; identical to SEQ ID NO: 759876

SEQ ID NO: 759885 - protein, 237 aa, Homo sapiens; identical to SEQ ID NO: 759876

SEQ ID NO: 759886 - protein, 237 aa, Homo sapiens; identical to SEQ ID NO: 759876

SEQ ID NO: 759887 - protein, 237 aa, Homo sapiens; identical to SEQ ID NO: 759876

SEQ ID NO: 759888 - protein, 237 aa, Homo sapiens; identical to SEQ ID NO: 759876

SEQ ID NO: 759889 - protein, 237 aa, Homo sapiens; identical to SEQ ID NO: 759876

SEQ ID NO: 759890 - protein, 237 aa, Homo sapiens; identical to SEQ ID NO: 759876

SEQ ID NO: 759891 - protein, 237 aa, Homo sapiens; identical to SEQ ID NO: 759876

SEQ ID NO: 759892 - protein, 237 aa, Homo sapiens; identical to SEQ ID NO: 759876

SEQ ID NO: 759893 - protein, 108 aa, Homo sapiens
MDCRGFHYASCLNTGLRGTGLRHYPVYKGRLNMKASTITSSHRSIIATTQRKLPFGNIHHLYKCYPHLTPPEPSLLPLTSIFSEAGSQQKGLIPFIGRGEESSTETPF

SEQ ID NO: 759894 - protein, 55 aa, Homo sapiens
RRCRYPLRAPGKPTAFPLLPAPALPALGPLSQVQRYHHPSCEAAINTHISLELHA

SEQ ID NO: 759895 - protein, 1872 aa, Homo sapiens
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISGSRSVQHSVGPQECGSVEALYLENSSTKLNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 759896 - protein, 1845 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 759897 - protein, 1854 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGGCRRVAGPHPRLLMRVGSTPLRMFLKLRFVKSKALGISVLKLQVLKMLQ

SEQ ID NO: 759898 - protein, 1602 aa, Homo sapiens
MIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 759899 - protein, 1600 aa, Homo sapiens
GLCSVAVASPCTASLASFAHFSLTCKSFSILLEFFVILGAYPLSDFRVTTVFSPLAARPSVNSGASCQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 759900 - protein, 1038 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGYNDDDVQITEDTINDIQTS

SEQ ID NO: 759901 - protein, 592 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGMASGLGPHGHWPRGPHTLLRTYTKHRYGTQ

SEQ ID NO: 759902 - protein, 218 aa, Homo sapiens
MIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQLQHILMTPAMPRPLHHTLKTQMFPAFQMSRRTPQTQSKKKNRKARRNWIKIESPFLPGSIREENVCV

SEQ ID NO: 759903 - protein, 1845 aa, Homo sapiens [sequence omitted]

SEQ ID NO: 759904 - protein, 1845 aa, Homo sapiens; identical to SEQ ID NO: 759896

SEQ ID NO: 759905 - protein, 1590 aa, Homo sapiens
MIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQLQHILMTPAMPRPLHHTLKTQMFPAFQMSRRTPQTQSKKKNRKARRNWIKKKKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPTSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 759906 - protein, 972 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVVSMDRGVHTWQYLAGAMLFFTVIIKNFLKGNFKRHAHFL

SEQ ID NO: 759907 - protein, 638 aa, Homo sapiens
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNVPVPDIPLQEPILITDLGKMDCRASL

SEQ ID NO: 759908 - protein, 61 aa, Homo sapiens
TQASHSSGIFPTTRNPEALDLEKNMKERCQEVQSGLLMMINGGSVSWWTWETGQINCCHLL

SEQ ID NO: 759909 - protein, 358 aa, Homo sapiens
MAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759910 - protein, 210 aa, Homo sapiens
GRVGRPTRREDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759911 - protein, 318 aa, Homo sapiens
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGPGPSTSQQPSLPRPSRAEGSRGRRQESGWKPPKNGGRHQGISRSEKESAPPGASGSTSVPPPQWTNPGAGDMAKRCRGALRKRRKRKAE

SEQ ID NO: 759912 - protein, 145 aa, Homo sapiens
QKAFFIPHEASRWPTVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759913 - protein, 150 aa, Homo sapiens
REGTRMKNDAVLELNKKWVLEEQEIIQVNRYRGKRVNTAKGSWADAEAAKEKKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759914 - protein, 142 aa, Homo sapiens
AAELLKKEKINSGQGLVQGHPSPDNGHLVILAEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759915 - protein, 358 aa, Homo sapiens; identical to SEQ ID NO: 759909

SEQ ID NO: 759916 - protein, 358 aa, Homo sapiens; identical to SEQ ID NO: 759909

SEQ ID NO: 759917 - protein, 358 aa, Homo sapiens; identical to SEQ ID NO: 759909

SEQ ID NO: 759918 - protein, 358 aa, Homo sapiens; identical to SEQ ID NO: 759909

SEQ ID NO: 759919 - protein, 358 aa, Homo sapiens; identical to SEQ ID NO: 759909

SEQ ID NO: 759920 - protein, 358 aa, Homo sapiens; identical to SEQ ID NO: 759909

SEQ ID NO: 759921 - protein, 358 aa, Homo sapiens; identical to SEQ ID NO: 759909

SEQ ID NO: 759922 - protein, 358 aa, Homo sapiens; identical to SEQ ID NO: 759909

SEQ ID NO: 759923 - protein, 317 aa, Homo sapiens
MAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEHKL

SEQ ID NO: 759924 - protein, 358 aa, Homo sapiens; identical to SEQ ID NO: 759909

SEQ ID NO: 759925 - protein, 358 aa, Homo sapiens; identical to SEQ ID NO: 759909

SEQ ID NO: 759926 - protein, 289 aa, Homo sapiens
RRLNAPPPRARPRQPPVAAGAAAISVCPRVRPVPACRTMESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGPGPSTSQQPSLPRPSRAEGSRG

SEQ ID NO: 759927 - protein, 358 aa, Homo sapiens; identical to SEQ ID NO: 759909

SEQ ID NO: 759928 - protein, 289 aa, Homo sapiens; identical to SEQ ID NO: 759926

SEQ ID NO: 759929 - protein, 358 aa, Homo sapiens; identical to SEQ ID NO: 759909

SEQ ID NO: 759930 - protein, 358 aa, Homo sapiens; identical to SEQ ID NO: 759909

SEQ ID NO: 759931 - protein, 358 aa, Homo sapiens; identical to SEQ ID NO: 759909

SEQ ID NO: 759932 - protein, 358 aa, Homo sapiens; identical to SEQ ID NO: 759909

SEQ ID NO: 759933 - protein, 358 aa, Homo sapiens; identical to SEQ ID NO: 759909

SEQ ID NO: 759934 - protein, 358 aa, Homo sapiens; identical to SEQ ID NO: 759909

SEQ ID NO: 759935 - protein, 346 aa, Homo sapiens
RMPSLRMLAMSTEGASSCGGIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759936 - protein, 356 aa, Homo sapiens
RRLNAPPPRARPRQPPVAAGAAAISVCPRVRPVPACRTMESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGPGPSTSQQPSLPRPSRAEGSRGRRQESGWKPPKNGGRHQGTSRSEKESAPPGASGSTSVPPPQWTNPGAGDMAKRCRGAPRKRRKRKAE

SEQ ID NO: 759937 - protein, 255 aa, Homo sapiens [sequence omitted]

SEQ ID NO: 759938 - protein, 215 aa, Homo sapiens
MEPGQTPAAKADLSLEGSSVLWPLGIAPYSLPPVPSVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759939 - protein, 145 aa, Homo sapiens
VIPLVIMDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759940 - protein, 207 aa, Homo sapiens
RRLNAPPPRARPRQPPVAAGAAAISVCPRVRPVPACRTMESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASTIIERGCRSYGAIASQHLCWLWL

SEQ ID NO: 759941 - protein, 133 aa, Homo sapiens
VFTPGAPLTFAPGGMGGGWARIPAHGWGGRGLISAYPFPHTPGEDGPSQMALEDLAMFRSVPTSTVFYPSDGVATEKAVELAANTKVGCMAVLSPAGSHHFPRETEEEARAGHLLPQGVFPDLAPGVRVACGS

SEQ ID NO: 759942 - protein, 358 aa, Homo sapiens; identical to SEQ ID NO: 759909

SEQ ID NO: 759943 - protein, 358 aa, Homo sapiens; identical to SEQ ID NO: 759909

SEQ ID NO: 759944 - protein, 275 aa, Homo sapiens
MAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVITDRVSRPRSLLLNNRQMSRTRVYSSRGIL

SEQ ID NO: 759945 - protein, 358 aa, Homo sapiens; identical to SEQ ID NO: 759909

SEQ ID NO: 759946 - protein, 358 aa, Homo sapiens; identical to SEQ ID NO: 759909

SEQ ID NO: 759947 - protein, 358 aa, Homo sapiens; identical to SEQ ID NO: 759909

SEQ ID NO: 759948 - protein, 358 aa, Homo sapiens; identical to SEQ ID NO: 759909

SEQ ID NO: 759949 - protein, 289 aa, Homo sapiens; identical to SEQ ID NO: 759926

SEQ ID NO: 759950 - protein, 289 aa, Homo sapiens; identical to SEQ ID NO: 759926

SEQ ID NO: 759951 - protein, 355 aa, Homo sapiens
MARYEPGFQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759952 - protein, 289 aa, Homo sapiens; identical to SEQ ID NO: 759926

SEQ ID NO: 759953 - protein, 255 aa, Homo sapiens [sequence omitted]

SEQ ID NO: 759954 - protein, 205 aa, Homo sapiens
RGPLQPSPTLGPLEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 759955 - protein, 145 aa, Homo sapiens; identical to SEQ ID NO: 759939

SEQ ID NO: 759956 - protein, 49 aa, Homo sapiens
MSHQAPTRADSGAQPSPQPRRVLSLTEKINIRVLDPFTIKPLDRKLILD

SEQ ID NO: 759957 - protein, 93 aa, Homo sapiens
KNMAEQIIQEIYSQIQSKKKILATPPQEDAPSVDIANIRMPSLPSYKVGDKVQSGACFSEPIVLRFPKSVAQIHPLEGWEREESDSFRARSDP

SEQ ID NO: 759958 - protein, 642 aa, Homo sapiens
MDSVSFEDVAVNFTLEEWALLDSSQKKLYEDVMQETFKNLVCLGKKWEDQDIEDDHRNQGKNRRCHMVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHSGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHEKIHTGNKPFECKQCGKAFLRSSQIRLHERTHTGEKPYQCKQCGKAFISSSKFRMHERTHTGEKPYRCKQCGKAFRFSSSVRIHERSHTGEKPYECKQCGKAFISSSHFRLHERTHMGEKV

SEQ ID NO: 759959 - protein, 622 aa, Homo sapiens
MVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHSGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHELPSFQSNSDCMKGLTLERNRINVNNVEKPSFLPVNFECMRELTRERNPIDVNNVGKPSDFQVLFEFMKGLTLERNLMNANNVEKPSFLPVTFDCMKGLIWERKSKNISNILKPSVVPAPSEYTKEFILDRSCVNTNIVLKPLIVPVSFEHERIPTGEKQYECKHCD

SEQ ID NO: 759960 - protein, 268 aa, Homo sapiens
MMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELWIKASVRKKKDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 759961 - protein, 1250 aa, Homo sapiens
VPETRADAAEAVQHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVVNKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 759962 - protein, 979 aa, Homo sapiens [sequence omitted]

SEQ ID NO: 759963 - protein, 31 aa, Homo sapiens
MSTISGTRSTTVTFTVRPGTSQPITLQSRPP

SEQ ID NO: 759964 - protein, 1784 aa, Homo sapiens
PVPAMPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAKKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQVPASRGPGGGSRGGVPRPSTLHGRSRPGGVSPGSVTEPGSEPGPPAAASTSVSPSLKWPNLVAAVHRGGWGQAPLGLGGWRRHLVLMGPRLPTQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNASWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSAPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 759965 - protein, 335 aa, Homo sapiens
RGGPQAAHLCARSHRILNLLGVFSSLSGLACLLSSVSLTPSGLVFHQLAFVPPFLCLSQPVAAPGHATFCLGPASLGLSLGFFSYSPGLGRGPGCLSRHTPHGVTPVGLHMGMCPYTSLGPQCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSAPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 759966 - protein, 1001 aa, Homo sapiens
PVPAMPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAKKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQVPASRGPGGGSRGGVPRPSTLHGRSRPGGVSPGSVTEPGSEPGPPAAASTSVSPSLKWPNLVAAVHRGGWGQAPLGLGGWRRHLVLMGPRLPTQLLFQESNPGVHYEYTIHREAGGHDEVPPPVFSWHYGPWTKCTVTCGRGEKWGRHSPTCRGLVSGQGHWLQLPAHCWATTGLEVCFSEPQFSICEMRLAIALCPRPAGRVHG

SEQ ID NO: 759967 - protein, 95 aa, Homo sapiens
APETGALCLVGSCWSLLKVVGCREPGSGYPKLLVLMPLCPPTPGCERDRLSFGFCETLRLLGRCQLPTIRTQCCRSCSPPSHGAPSRGHQRVARR

SEQ ID NO: 759968 - protein, 193 aa, Homo sapiens
STTRPRTRGPAAAARGAPSSAKPLAPSPPGSGSPAAAGAPASEPLSEVSHGIDSGLPGGRALRRELRARGEGDGAKKNRGDSAAAVTAGTRRGRAAPSPRPDRSPAGEGLRRRRRRRPWWQWWRRSSLPGSCPELEERVVPGELCTGAAASPPVPPPQSPRSRRIRRRRRRQDMELENIVANSLLLKARQGRI

SEQ ID NO: 759969 - protein, 257 aa, Homo sapiens
STTRPRTRGPAAAARGAPSSAKPLAPSPPGSGSPAAAGAPASEPLSEVSHGIDSGLPGGRALRRELRARGEGDGAKKNRGDSAAAVTAGTRRGRAAPSPRPDRSPAGEGLRRRRRRRPWWQWWRRSSLPGSCPELEERVVPGELCTGAAASPPVPPPQSPRSRRIRRRRRRQDMELENIVANSLLLKARQVLCIPPQKHQLVQPFSGRPPQSSVQSSVSDLMSPLPASQESWRQSLGPQVPVLATVVLHTPSLLRNC

SEQ ID NO: 759970 - protein, 397 aa, Homo sapiens
STTRPRTRGPAAAARGAPSSAKPLAPSPPGSGSPAAAGAPASEPLSEVSHGIDSGLPGGRALRRELRARGEGDGAKKNRGDSAAAVTAGTRRGRAAPSPRPDRSPAGEGLRRRRRRRPWWQWWRRSSLPGSCPELEERVVPGELCTGAAASPPVPPPQSPRSRRIRRRRRRQDMELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEQSPVGCAVDGSWKKQQPNVDDTEA

SEQ ID NO: 759971 - protein, 1376 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDVSSLSFYVSLLFWQNLFQLLSYLILRMNDEPVVEWGEQEDY

SEQ ID NO: 759972 - protein, 1406 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 759973 - protein, 1336 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDY

SEQ ID NO: 759974 - protein, 1364 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDATLRLPYCEEAWNENNMSRESPSHARHPC

SEQ ID NO: 759975 - protein, 661 aa, Homo sapiens
MEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICAREGLWLHIDAAYAGTAFLCPEFRGFLKGIEYADSFTFNPSKWMMVHFDCTGFWVKDKYKLQQTFSVNPIYLRHANSGVATDFMHWQIPLSRRFRSVKLWFVIRSFGVKNLQAHVRHGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 759976 - protein, 936 aa, Homo sapiens
MEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICKYLPSVAEEDKEYIFKCLLKQGPETSSMGLFLFLFGQCRDMGRTTKGHEGLFQGSLDIAFPSGVTRVRGGLPCLLSQEATVGEPSVFSSSYLYVELYLMQAISKIQCELGRIEMLSILPSEKEKGRVGEIMGEIKGREETQMGLFNPQARNHRKERYLPSNFCIRCTDIALCAGGKLISVPGCSRLRPRGCWPFTQWKKKARVRLCRLSHSEVMMPPSAPLLQTDSTCSHLHTPPVSHLAKAHHPCSPPLSLARCETSFPTSYLPSGQVMFASSGAREGLWLHIDAAYAGTAFLCPEFRGFLKGIEYADSFTFNPSKWMMVHFDCTGFWVKDKYKLQQTFSVNPIYLRHANSGVATDFMHWQIPLSRRFRSVKLWFVIRSFGVKNLQAHVRHGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 759977 - protein, 95 aa, Homo sapiens
RHKSPTNCPIFALTFALVVLAFPAYLLGIDSGRLQEKLTSRKMDSRWGGRSESINVTLNVEQAAYTRDALAKGLYARLFDFLVEINRAMHEHTPV

SEQ ID NO: 759978 - protein, 258 aa, Homo sapiens
MGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVERPSTVLSSNPTEER

SEQ ID NO: 759979 - protein, 280 aa, Homo sapiens
MGYISKVSGGGEKVQHVKDIILQSNPLLEAFGNAKTVRNNNSSRFGKYFEIQFSRGGEPDGGKISNFLLEKSRVVMQNENERNFHIYYQVQEKGPGEREHHLEPSGVDNGKLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVERPSTVLSSNPTEER

SEQ ID NO: 759980 - protein, 542 aa, Homo sapiens
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQVSLLASGPEAQQPEGPCLRVADLGRRAPD

SEQ ID NO: 759981 - protein, 108 aa, Homo sapiens
SALGGSLLPQLRTELGPGQRPLPRGWTRRPGHTRAWTFGAGEQGLRCLNVRAKCLWSAAPALEGSPAVSPPDSHQRPLGSTPVPKRTPLDLPAQAPSLPGPCFACPLS

SEQ ID NO: 759982 - protein, 147 aa, Homo sapiens
PEKARTEAHTGVFWVMRPSCAGRQGQGKLGSMDGEAEGWEEGRGEGQPAGVAEEQEGGEKPGDLSEMPSPGWHWVGWGRMVSWQQRMGNLQMNMDRRAAKHQKNKVSYPGHSPFHTLPAPGSEPDAASSGPVPVGAHILSKRLQRDL

SEQ ID NO: 759983 - protein, 558 aa, Homo sapiens
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQKWRRKGSFIQHSVSGLCLETKPAQLVTSKCQADAQAQQWQLLPHT

SEQ ID NO: 759984 - protein, 558 aa, Homo sapiens; identical to SEQ ID NO: 759983

SEQ ID NO: 759985 - protein, 329 aa, Homo sapiens
LLKPTGRWHSAGMTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 759986 - protein, 329 aa, Homo sapiens; identical to SEQ ID NO: 759985

SEQ ID NO: 759987 - protein, 178 aa, Homo sapiens [sequence omitted]

SEQ ID NO: 759988 - protein, 155 aa, Homo sapiens
IESSSYQIPFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 759989 - protein, 288 aa, Homo sapiens
LLKPTGRWHSAGMTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQANSTDPVKAAQFEPPGRQMIAIRKRQLEETNNDYETADGGYMTLNPRAPTDDDKNIYLTLPPNDHVNSNN

SEQ ID NO: 759990 - protein, 137 aa, Homo sapiens
MLRCHSWKDKPLVKVTFFQNGKSQKFSRLDPTFSIPQANHSHSGDYHCTGNIGYTLFSSKPVTITVQANSTDPVKAAQFEPPGRQMIAIRKRQLEETNNDYETADGGYMTLNPRAPTDDDKNIYLTLPPNDHVNSNN

SEQ ID NO: 759991 - protein, 77 aa, Homo sapiens
AHEEEAAVSYNHTTAVCLGDRVRPRGLKEQGGTEIRFRADRLADHGKYMTLNPRAPTDDDKNIYLTLPPNDHVNSNN

SEQ ID NO: 759992 - protein, 329 aa, Homo sapiens; identical to SEQ ID NO: 759985

SEQ ID NO: 759993 - protein, 329 aa, Homo sapiens; identical to SEQ ID NO: 759985

SEQ ID NO: 759994 - protein, 329 aa, Homo sapiens; identical to SEQ ID NO: 759985

SEQ ID NO: 759995 - protein, 83 aa, Homo sapiens
LLKPTGRWHSAGMTMETQMSQNVCPRNLWLLQPLTVLLLLGVRVILKWGNFRHSYCLDSRYQCGKEQAWALEAGDRLKEERGP

SEQ ID NO: 759996 - protein, 99 aa, Homo sapiens
IKKINAIRRDREDKKITDSTDLVKAAQFEPPGRQMIAIRKRQLEETNNDYETADGGYMTLNPRAPTDDDKNIYLTLPPNDHVCSYQKDVTFSEKSFQAD

SEQ ID NO: 759997 - protein, 262 aa, Homo sapiens
LLKPTGRWHSAGMTMETQMSQNVCPRNLWLLQPLTVLLLLAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQGMGSLPRCREGRRGDGQGLRSHGPTWRSEKAHSSKIGHWSKEEWGGSLAKY

SEQ ID NO: 759998 - protein, 318 aa, Homo sapiens
LLKPTGRWHSAGMTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGIIVAVVIATAVAAIVAAVVALIYCRKKRISANSTDPVKAAQFEMSNPSHLLFFLPCPFSPVSSLFAFVNAKLKWRLGLKTPEQTKPPRP

SEQ ID NO: 759999 - protein, 108 aa, Homo sapiens
MGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 760000 - protein, 329 aa, Homo sapiens; identical to SEQ ID NO: 759985

SEQ ID NO: 760001 - protein, 329 aa, Homo sapiens; identical to SEQ ID NO: 759985

SEQ ID NO: 760002 - protein, 333 aa, Homo sapiens
LLKPTGRWHSAGMTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVGCIDWGVD

SEQ ID NO: 760003 - protein, 329 aa, Homo sapiens; identical to SEQ ID NO: 759985

SEQ ID NO: 760004 - protein, 108 aa, Homo sapiens
THTGEKKFVCSECSKCFVRSDHLAEHTKTQQNKKGIHSSSTVLASVEAARDDTLITAGGTKLILANIQQGSVSGIGTVNTSATSNQDILTNTEIPLQLVTVSGNETME

SEQ ID NO: 760005 - protein, 212 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 760006 - protein, 212 aa, Homo sapiens; identical to SEQ ID NO: 760005

SEQ ID NO: 760007 - protein, 212 aa, Homo sapiens; identical to SEQ ID NO: 760005

SEQ ID NO: 760008 - protein, 120 aa, Homo sapiens
MWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 760009 - protein, 212 aa, Homo sapiens; identical to SEQ ID NO: 760005

SEQ ID NO: 760010 - protein, 331 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 760011 - protein, 224 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRPSTDAAPGGVPAACAAGEGTHRVRALQRWGGPLHRGCLRLAPVCDGLESEEGAVFPHGQEAGCLH

SEQ ID NO: 760012 - protein, 162 aa, Homo sapiens
QTKNLRPARVSDLVKIGSAPETRSKIFPRFTIRRRLSRGNGPHHDRCCTYNENNLVDGVYCLPIGHWIEATGHTNEMKHTTDFYFNIAGHQAMHYSRPSTDAAPGGVPAACAAGEGTHRVRALQRWGGPLHRGCLRLAPVCDGLESEEGAVFPHGQEAGCLH

SEQ ID NO: 760013 - protein, 142 aa, Homo sapiens
MNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 760014 - protein, 317 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEAASQDTFPL

SEQ ID NO: 760015 - protein, 224 aa, Homo sapiens; identical to SEQ ID NO: 760011

SEQ ID NO: 760016 - protein, 177 aa, Homo sapiens
MIFNKILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 760017 - protein, 233 aa, Homo sapiens
MIFNKILPNIWLGSCPRQVEHVTIKLKHELGITAVMNFQTEWDIVQNSSGCNRYPEPMTPDTMIKLYREEGLAYIWMPTPDMSTEGWQSDPEHCSRQQLYQLMKLLPAFLHRRFRQVLQTHAISTPYVHDHLELGRAYKLKGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 760018 - protein, 267 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGKDQNCSASLLYFRETLAVCLSIYNLIS

SEQ ID NO: 760019 - protein, 92 aa, Homo sapiens
SDADLAERREESGRSAGGRGAADHGAPESLVNVFWTKQEDVTEILKGAGSCSTRIMIHLGTFLFTAFDSGSKVLTKCTSLKGVKERNLFIKP

SEQ ID NO: 760020 - protein, 682 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELNTLLPISHENLTGSATNISHLCGRQKADTNTE

SEQ ID NO: 760021 - protein, 684 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELNTLLPISHENLTGSATNKSEVPEESAQKNTFVSY

SEQ ID NO: 760022 - protein, 87 aa, Homo sapiens
SRQMVTDLELSTLLPISHENLTAVPQKVRGPRRVSSKKYLCQLLKETKGNFSIHRDHEFLIYVEGRKQTPILNEYLTVKLKEDSSSS

SEQ ID NO: 760023 - protein, 684 aa, Homo sapiens; identical to SEQ ID NO: 760021

SEQ ID NO: 760024 - protein, 672 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTDNDKAKDCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELNTLLPISHENLTGSATNKSEVPEESAQKNTFVSY

SEQ ID NO: 760025 - protein, 120 aa, Homo sapiens
DLGELSPMPMMISWEPFCFLPRWLGHLQGVGAKSMARLSRAQQAEVDGHSGVRSLGPDSPSRVGQDRAGLEDLQSHKWAGLYLQKGVDSPGLGDSPSSVSLLSSWDYRHPPLRPANFLYF

SEQ ID NO: 760026 - protein, 95 aa, Homo sapiens
VTWSLVAPARERGTLPAPSWSGEGLVAAQVQWAGGQGSPCRGTAWPLFSVPLPWVGLQALSHGFGWGAASPSSPSSKLLRKSWAEHSRGGLGPQD

SEQ ID NO: 760027 - protein, 404 aa, Homo sapiens
MVRGWVLNGRGSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760028 - protein, 135 aa, Homo sapiens
RAVRAGAAAARRRGPRASERRGRRSHDRGVRGVRQGLPALQLVKLCSGMVEAGKAYVSTSRLFVSGVRDLSQQCQGDTVISVRGRLTSDLKECLQRFADSLQEVVNYHMILFDQAQRSVRQQLQSFVKEPGGACL

SEQ ID NO: 760029 - protein, 826 aa, Homo sapiens
ERSGPARLPLGAAVLVPVSAAAAAAMTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760030 - protein, 796 aa, Homo sapiens
MEAKKPLCIPKATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760031 - protein, 826 aa, Homo sapiens; identical to SEQ ID NO: 760029

SEQ ID NO: 760032 - protein, 897 aa, Homo sapiens
RWSPLWPQSLAPCGAFACLWDSSPGHHPGQRLAAGRSGYFGIGESPPGVGDGSTSHQELGTGPPVTRSWQPSLTGFLPLPPPAPALQTLLQVSEHGPWAGCGSGETRWGGAFPSSTPRALQHQGHLPPVSAPAADAAVRGWLRPDLHIPRGVGGSCPFPSHVAWGAGGRPSPLLPWPARWRDTQGPQLTPRPPEWGSVRPAGHMNGALRMRRVGAQLLPDRSLLVPAGLGWGRHSRAPSCEREGSAPRVAGLGALLRSRSGCGEQRVSRLSVWSVGRVAASDKDLTTHLCSGKARRVAGPLGWALRGRVPSPQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760033 - protein, 675 aa, Homo sapiens
RWSPLWPQSLAPCGAFACLWDSSPGHHPGQRLAAGRSGYFGIGESPPGVGDGSTSHQELGTGPPVTRSWQPSLTGFLPLPPPAPALQTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760034 - protein, 572 aa, Homo sapiens
SRELDTGLGAQAVGLRVSKVKQEVGGRGRVVAEGRGHSGAAQQDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760035 - protein, 717 aa, Homo sapiens
ERSGPARLPLGAAVLVPVSAAAAAAMTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEADEEGATVRQRAKAKNTGTRRPRPGPGQTPHDPSLGHTQRPNRVRGRTDSLEPDT

SEQ ID NO: 760036 - protein, 117 aa, Homo sapiens
MFTDVCTSVHRLCLVDIWQTTMEAKKPLCIPKATIDEVETDVVEIEAKLDKVKGGPGAPCARPSLGWPHGQTRPPGLTKPLTPPICGACVWCSRSWSLCLSMCVPGCTCHMHTCGWP

SEQ ID NO: 760037 - protein, 759 aa, Homo sapiens
MVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760038 - protein, 138 aa, Homo sapiens
ERSGPARLPLGAAVLVPVSAAAAAAMTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKE

SEQ ID NO: 760039 - protein, 817 aa, Homo sapiens
MFTDVCTSVHRLCLVDIWQTTMEAKKPLCIPKATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760040 - protein, 680 aa, Homo sapiens
RWSAPEVRDLPHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 760041 - protein, 162 aa, Homo sapiens
MCGCARARWVSWDLLASQHVCGGTGSLCIPGALTRRLRSLGVGGSGPARRVAPSPGQRNWGHPLLSQGRKGGPSREPTSTSLSDPSIQAGVAGAGREGLWPGSSALAGRGRPKATWLATKVPVPDSPSRIPASSGGTFSWYSAQSLRIKPLCHFAALISCSL

SEQ ID NO: 760042 - protein, 259 aa, Homo sapiens
ERSGPARLPLGAAVLVPVSAAAAAAMTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAEVSLWEGWGWARPP

SEQ ID NO: 760043 - protein, 174 aa, Homo sapiens
YTSCLCVWSWLESLSLTCQTTPPPSSPCLLHSPETFIHTMPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVCEQVFRKVR

SEQ ID NO: 760044 - protein, 136 aa, Homo sapiens
YTSCLCVWSWLESLSLTCQTTPPPSSPCLLHSPETFIHTMPPNLTGYYRFVSQKNMEDYLQALNISLAVRKIALLLKPDKEIEHQGNHMTVRTLSTFRNYTVQFDVGVEFEEDLRSVDGRKCQAALGMNSPARAIS

SEQ ID NO: 760045 - protein, 103 aa, Homo sapiens
VEANTDLWMAEFWMTDSPRSCSRFLPQEGSYISLAVRKIALLLKPDKEIEHQGNHMTVRTLSTFRNYTVQFDVGVEFEEDLRSVDGRKCQAALGMNSPARAIS

SEQ ID NO: 760046 - protein, 174 aa, Homo sapiens; identical to SEQ ID NO: 760043

SEQ ID NO: 760047 - protein, 143 aa, Homo sapiens
YTSCLCVWSWLESLSLTCQTTPPPSSPCLLHSPETFIHTMPPNLTGYYRFVSQKNMEDYLQALNISLAVRKIALLLKPDKEIEHQGNHMTVRTLSTFRNYTVQFDVGVEFEEDLRSVDGRKCQGRSPTGAGDTGWRERCCIWN

SEQ ID NO: 760048 - protein, 164 aa, Homo sapiens
YHQPKGQRTGQPRPKSKHLPTLQPVTLLVTQSPFYFSINNFTLLHFFLLLTYSFLASFADPSPPINPLNWSFLRRVLFLMSSPFCLPTIHRLNHLHPCLLLPSIGCPWHEFSSQSHLLSSRAMFSTAYKIQLALHIHGFCIHSFSKLQMEKYLGKIKIKNNNTK

SEQ ID NO: 760049 - protein, 665 aa, Homo sapiens
MAGLSGAQIPDGEFTALVYRLIRDARYAEAVQLLGRELQRSPRSRAGLSLLGYCYYRLQEFALAAECYEQLGQLHPELEQYRLYQAQALYKACLYPEATRVAFLLLDNPAYHSRVLRLQAAIKYSEGDLPGSRSLVEQLLSGEGGEESGGDNETDGQVNLGCLLYKEGQYEAACSKFSATLQASGYQPDLSYNLALAYYSSRQYASALKHIAEIIERGIRQHPELGVGMTTEGFDVRSVGNTLVLHQTALVEAFNLKAAIEYQLRNYEVAQETLTDMPPRAEEELDPVTLHNQALMNMDARPTEGFEKLQFLLQQNPFPPETFGNLLLLYCKYEYFDLAADVLAENAHLTYKFLTPYLYDFLDALITCQTAPEEAFIKLDGLAGMLTEQLRRLTKQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPNRKMYHLCIVNLVIGTLYCAKGNYEFGISRVIKSLEPYNKKLGTDTWYYAKRCFLSLLENMSKHMIVIHDSVIQECVQFLGHCELYGTNIPAVIEQPLEEERMHVGKNTVTDESRQLKALIYEIIGWNK

SEQ ID NO: 760050 - protein, 665 aa, Homo sapiens; identical to SEQ ID NO: 760049

SEQ ID NO: 760051 - protein, 557 aa, Homo sapiens
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 760052 - protein, 478 aa, Homo sapiens
TTTKFAAASTRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 760053 - protein, 557 aa, Homo sapiens; identical to SEQ ID NO: 760051

SEQ ID NO: 760054 - protein, 408 aa, Homo sapiens
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTFSLSRLLSTTLNTTLKMLTILGFGTPLLRLYSYATT

SEQ ID NO: 760055 - protein, 557 aa, Homo sapiens; identical to SEQ ID NO: 760051

SEQ ID NO: 760056 - protein, 255 aa, Homo sapiens
MECTLGQVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 760057 - protein, 156 aa, Homo sapiens
MCSEATWVSNWYCIVLVSLTSSPPNHHGASELQQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 760058 - protein, 262 aa, Homo sapiens
MSEGRGLPPPPRRDWGDHGRREDDRSWQGTADGGMMDRDHKRWQGEEQLWAGTRMCWGVMERWRPRLLSLGEHRRCSALSAGMRNEEHSRHRLLSGGLAQELDSGRSRVLSAGRKPGRLWSLCPGVFLGPASCGYLGASPKGVEWAKCAVGSTPCAQVPCVKARLSSRWREKHVRSLRAWPHDEPRRNVRARQLCPRRGLPGPPHPTRWHAGRVWRPEPGEQAQRCPLHSPLLSTWNPVSCLVATRLCSVRSYLKLCKNIFF

SEQ ID NO: 760059 - protein, 382 aa, Homo sapiens
VGPGAGECSRELCLRGGSDRRPGPARRSWPAGEGREARAGGSARPGPRALAEAGRAPSPPGAHARRLASAAAEGGARLCMAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 760060 - protein, 303 aa, Homo sapiens
MAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 760061 - protein, 160 aa, Homo sapiens
MHGTEALGGTQYAGRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 760062 - protein, 190 aa, Homo sapiens
MHGTEALGGTQYLVLFGYYYYFLGSSCSDASLLTPCFFFFRPSGRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 760063 - protein, 445 aa, Homo sapiens
VGPGAGECSRELCLRGGSDRRPGPARRSWPAGEGREARAGGSARPGPRALAEAGRAPSPPGAHARRLASAAAEGGARLCMAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARWVWSPPGFDPFGETPPKDGHPCKPGEDAPFSTNGRQGFGGGARWDADKGFPAKNGMGTPVVPLQTRNAAGGSSSKVRFQRFKLWTHARQRVGKDCWASQENPGRRQGANEGPTEEGQHVWEQSLEVWACQGLVVGPRGGLGASSFPFGGAPELCTGPRRVAPHLRGAGAPSGARVAVAPGEPYRPLVVNVSLIEARPHLEVLRWVPDAR

SEQ ID NO: 760064 - protein, 170 aa, Homo sapiens
LKPFSSGEAAKSSVHKTKSGCQRPRPQVGIRDHPLTGHKVSFPPEPGPLSPYSASVVPGAPVWSGESRSSACLGKRGPWPATPQRHYTTPGAPARIEAMTRCRWVPGPLWVGTGPQHHSPLPGRPGTSRLLSQPCPLARPCHREGPQPIMGIGRAWPLPPPARSLASVDA

SEQ ID NO: 760065 - protein, 134 aa, Homo sapiens
STDGIGFLRSTEERKNILHLDHASLESASTDGISFEPGHSQGWETGRLSPVRKELNLNATRPSFPPKEALKVLPKSVTQTAPAPAKAEVLFSRMGAKQRLLPECSFLPSLLKEQSVVTCLLSVSNCSLTCTCTM

SEQ ID NO: 760066 - protein, 247 aa, Homo sapiens
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEAFIGIAECTSMIGYALGYVLGAPLVKVPENTTSATKFNTDKS

SEQ ID NO: 760067 - protein, 343 aa, Homo sapiens
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKMFIGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFI

SEQ ID NO: 760068 - protein, 419 aa, Homo sapiens
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINEKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 760069 - protein, 419 aa, Homo sapiens; identical to SEQ ID NO: 760068

SEQ ID NO: 760070 - protein, 483 aa, Homo sapiens
MDTCFAHACTGHACTGHMHRMHVLYRTHVLHMETHIHALQRDTGKHAYNGYMFTHGRMFCTGHMHRMHVLHTDTHVYIGQVHRARFAPDVFCARDARFADASTHTPRRDGRSGVGSDSGVRTQGQRSGNLPRRRELQLPARSPRDDARPSADWPRPAAPRGPAQVPAPRVAARPPVSRMEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAAVMNVCSYREKVEEAELTLFSELPTVLGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 760071 - protein, 378 aa, Homo sapiens
IHGHMFCTRLHRTRLHRTHAQDACFVQDTCFAHGNTYPCFAKGHREACLQWIHVYTRTHVLHRTYAQDACFAHGHTRLHRTSAQGTFCTGRILCTGRTVCRCKHTHSSARRAKRGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 760072 - protein, 134 aa, Homo sapiens
GAAVRPTVALKWGSHSSPREFACPWGVRGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 760073 - protein, 392 aa, Homo sapiens
MDTCFAHACTGHACTGHMHRMHVLYRTHVLHMETHIHALQRDTGKHAYNGYMFTHGRMFCTGHMHRMHVLHTDTHVYIGQVHRARFAPDVFCARDARFADASTHTPRRDGRSGVGSDSGVRTQGQRSGNLPRRRELQLPARSPRDDARPSADWPRPAAPRGPAQVPAPRVAARPPVSRMEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSELSPPPEHPGFDALDQLSQVELLGDMDRNEFDQYLNTPGHPDSATGAMALSGHVPVSQVTPTGPTETSLISVLADATATYYNSYSVS

SEQ ID NO: 760074 - protein, 328 aa, Homo sapiens
MDTCFAHACTGHACTGHMHRMHVLYRTHVLHMETHIHALQRDTGKHAYNGYMFTHGRMFCTGHMHRMHVLHTDTHVYIGQVHRARFAPDVFCARDARFADASTHTPRRDGRSGVGSDSGVRTQGQRSGNLPRRRELQLPARSPRDDARPSADWPRPAAPRGPAQVPAPRVAARPPVSRMEPRAADGCFLGDVGTCGRRGGQSEAAAPAPEPAAYPMACAGEVVARPALAPWAGAFGGVGRGESRVPVVPRIPDGLSCLVPCPRPAHCGVAVRAARQVWGFATANPPSAARPGEGAGRVRGRCPVAGESLGNAHGAPSRGSQARAHGKS

SEQ ID NO: 760075 - protein, 114 aa, Homo sapiens
KQTPKAHKRQSQWTSCPELHFLGSLPRVPGCPSREGLQDTSRFQGKGRRFRFPLSLCSIAGVVLLPEINLTSFLAPFFRDTSDSVTALQGELEEGHWRPRAGEDCQVKHPAPAH

SEQ ID NO: 760076 - protein, 456 aa, Homo sapiens
MDTCFAHACTGHACTGHMHRMHVLYRTHVLHMETHIHALQRDTGKHAYNGYMFTHGRMFCTGHMHRMHVLHTDTHVYIGQVHRARFAPDVFCARDARFADASTHTPRRDGRSGVGSDSGVRTQGQRSGNLPRRRELQLPARSPRDDARPSADWPRPAAPRGPAQVPAPRVAARPPVSRMEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 760077 - protein, 260 aa, Homo sapiens
MDTCFAHACTGHACTGHMHRMHVLYRTHVLHMETHIHALQRDTGKHAYNGYMFTHGRMFCTGHMHRMHVLHTDTHVYIGQVHRARFAPDVFCARDARFADASTHTPRRDGRSGVGSDSGVRTQGQRSGNLPRRRELQLPARSPRDDARPSADWPRPAAPRGPAQVPAPRVAARPPVSRMEPRAADGCFLGDVGFWVERTPVHEAAQRGESLQLQQLIESGACVNQVTVDSITPLHAASLQGQARCVQLLLAAGAQGVPNV

SEQ ID NO: 760078 - protein, 456 aa, Homo sapiens; identical to SEQ ID NO: 760076

SEQ ID NO: 760079 - protein, 456 aa, Homo sapiens; identical to SEQ ID NO: 760076

SEQ ID NO: 760080 - protein, 107 aa, Homo sapiens
MADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCFFSGKILQLLFHL

SEQ ID NO: 760081 - protein, 237 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSW

SEQ ID NO: 760082 - protein, 1307 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760083 - protein, 1198 aa, Homo sapiens
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760084 - protein, 1102 aa, Homo sapiens
RWGDSSVIRNANDDNCVLIFILRFEFCVSNFSLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760085 - protein, 1307 aa, Homo sapiens; identical to SEQ ID NO: 760082

SEQ ID NO: 760086 - protein, 718 aa, Homo sapiens
MMCQGHVFIWKVCANGLLFPLNVLVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760087 - protein, 439 aa, Homo sapiens
RLSEGCHANRYTHFSFSECSQRLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760088 - protein, 1073 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQPTAPVSRI

SEQ ID NO: 760089 - protein, 1307 aa, Homo sapiens; identical to SEQ ID NO: 760082

SEQ ID NO: 760090 - protein, 848 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEQRVLVQHGRHGAGVECEHTAGDQPLPAAARWPDVHQTARRPPVVCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760091 - protein, 248 aa, Homo sapiens
MVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760092 - protein, 146 aa, Homo sapiens
MVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 760093 - protein, 1488 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVGWRARHPQHPRQVSLALAASPCSREPATRPCALLPSPLRAPLLTGTCRVGANGPQVTMCWFHGVVQALHSAFPQTGWLQMTELNFLTVLDAGGPKPRCRQSRFPRGLGGSVHSRPFSPPPAHVAAVLGVPWLWTWHSNLCLHHMALSLPVCVSYGDAGRTGLTSVTTSELSADSTSKEAHILRFRGYGFGGTLFNPLQSALWPPKSTSVPHAKYTPSITTSPEVPVPPVSVLSPKSPSEAKALRCG

SEQ ID NO: 760094 - protein, 1449 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVGWRARHPQHPRQVSLALAASPCSREPATRPCALLPSPLRAPLLTGTCRVGANGPQVTMCWFHGVVQALHSAFPQTGWLQMTELNFLTVLDAGGPKPRCRQSRFPRGLGGSVHSRPFSPPPAHVAAVLGVPWLWTWHSNLCLHHMALSLPVCVSYGDAGRTGLTSVTTSELSAEENYVASSSPKAVLAARAPSHFLALERLDFAFVNT

SEQ ID NO: 760095 - protein, 1266 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVGWRARHPQHPRRVPPGAEPTPLAP

SEQ ID NO: 760096 - protein, 1071 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVVSTRSVRKEASEFT

SEQ ID NO: 760097 - protein, 960 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKVGDAGPLCPLLWLPQGPLATCGSCGSPQL

SEQ ID NO: 760098 - protein, 929 aa, Homo sapiens
GGAAGPQGSAGDCAAEAPECGTGGGRRAAMAEAASPHLSLPSGLLELCALLGAPRDSLRSLEQVAYKKGVKHLSALLDPEVLSIFVPPFISKEDSQTAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEVRTAQADGARPHLCLGDRWLEWALSSLPAMPSTSCSPSADRMPSCPSVCSSVKQE

SEQ ID NO: 760099 - protein, 340 aa, Homo sapiens
ACGRLWCCTGNSIMVMKMNGSLHQELKIEENFKDTSTSFLAFQLLPEEEQLWAACAGRSEVYIWSLKDLAQPPQRVPLEDCSEINCMIRVKKQVGWRARHPQHPRQVSLALAASPCSREPATRPCALLPSPLRAPLLTGTCRVGANGPQVTMCWFHGVVQALHSAFPQTGWLQMTELNFLTVLDAGGPKPRCRQSRFPRGLGGSVHSRPFSPPPAHVAAVLGVPWLWTWHSNLCLHHMALSLPVCVSYGDAGRTGLTSVTTSELSADSTSKEAHILRFRGYGFGGTLFNPLQSALWPPKSTSVPHAKYTPSITTSPEVPVPPVSVLSPKSPSEAKALRCG

SEQ ID NO: 760100 - protein, 118 aa, Homo sapiens
GLPLPKYTSLCATCQALPQTWGHSAVTQQLGDFAFGERSWSCCCRRWGDSSVIRNANDDNCVLIFILRFEFCVSNFSLLALLKPCKDFEVDSHIKDFAAKLSLIPSPPPGPLHLVKYI

SEQ ID NO: 760101 - protein, 50 aa, Homo sapiens
MCTVFSGAQVKGVCVCFVPPNVYSCSMDGMVLVWNVSTLQVTSRFQLPRG

SEQ ID NO: 760102 - protein, 139 aa, Homo sapiens
HDSTRPSSCVVSADQALCGLEECRPLLLRPGPRASLMGAPQEGSDAGRGRFLGSEVRHSGPGAAFTPGVSISSWNLQPPPFPVFHSPVLAAPHCPPEGVVSSPPESGLGPRPSSSARKSPETQVLDQGPQGGDPAARVG

SEQ ID NO: 760103 - protein, 139 aa, Homo sapiens; identical to SEQ ID NO: 760102

SEQ ID NO: 760104 - protein, 586 aa, Homo sapiens
APCSLRGNKVLRAGDGGGANPAGPPVTLVLHFPACVCEWVCVFSYKGYFAIDRLIRSSPPRAFALCAVIELPPSQVLLRSSKRQRLDVSAGRRFVPSVPASPLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 760105 - protein, 338 aa, Homo sapiens
MREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 760106 - protein, 286 aa, Homo sapiens
MFLESKYVSLHLKSRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 760107 - protein, 586 aa, Homo sapiens
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 760108 - protein, 387 aa, Homo sapiens
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEER

SEQ ID NO: 760109 - protein, 586 aa, Homo sapiens; identical to SEQ ID NO: 760107

SEQ ID NO: 760110 - protein, 586 aa, Homo sapiens; identical to SEQ ID NO: 760107

SEQ ID NO: 760111 - protein, 586 aa, Homo sapiens; identical to SEQ ID NO: 760107

SEQ ID NO: 760112 - protein, 586 aa, Homo sapiens; identical to SEQ ID NO: 760107

SEQ ID NO: 760113 - protein, 222 aa, Homo sapiens [sequence omitted]

SEQ ID NO: 760114 - protein, 114 aa, Homo sapiens
MHNVTHSHTFLFSSEPSKVICQQRWHCSFAWLLSLEASLPREGTAGEAVVLAHCLSPSVLKEKRQPAVRAVRKASRPPCSSPPSVAQGFVEVELPTSNLVWLLLRREADPSLLS

SEQ ID NO: 760115 - protein, 114 aa, Homo sapiens; identical to SEQ ID NO: 760114

SEQ ID NO: 760116 - protein, 327 aa, Homo sapiens
PPETHSALALTCLLIGGWLLRIMTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 760117 - protein, 128 aa, Homo sapiens
SGSCKCSLPRACVPHCAHPPSQILTAVMACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 760118 - protein, 146 aa, Homo sapiens
AVEAGDIKRVFVPSSGFTFQAEILPLSTTLSPQRFFFLGLILTAVMACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 760119 - protein, 146 aa, Homo sapiens; identical to SEQ ID NO: 760118

SEQ ID NO: 760120 - protein, 146 aa, Homo sapiens; identical to SEQ ID NO: 760118

SEQ ID NO: 760121 - protein, 146 aa, Homo sapiens; identical to SEQ ID NO: 760118

SEQ ID NO: 760122 - protein, 146 aa, Homo sapiens; identical to SEQ ID NO: 760118

SEQ ID NO: 760123 - protein, 146 aa, Homo sapiens; identical to SEQ ID NO: 760118

SEQ ID NO: 760124 - protein, 128 aa, Homo sapiens; identical to SEQ ID NO: 760117

SEQ ID NO: 760125 - protein, 146 aa, Homo sapiens; identical to SEQ ID NO: 760118

SEQ ID NO: 760126 - protein, 146 aa, Homo sapiens; identical to SEQ ID NO: 760118

SEQ ID NO: 760127 - protein, 146 aa, Homo sapiens; identical to SEQ ID NO: 760118

SEQ ID NO: 760128 - protein, 474 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 760129 - protein, 474 aa, Homo sapiens; identical to SEQ ID NO: 760128

SEQ ID NO: 760130 - protein, 508 aa, Homo sapiens
MQFSGEKISGQRDLQKSKMRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 760131 - protein, 76 aa, Homo sapiens
VTYAIYTVSELQPSDSCDGRLCLGSYILVRKLENMAVGPALWLTPVIPALWEAEAGGSRGQEIETILANTVKPRIY

SEQ ID NO: 760132 - protein, 181 aa, Homo sapiens [sequence omitted]

SEQ ID NO: 760133 - protein, 225 aa, Homo sapiens
MERAEPQRRALRFDVTSCEPGGDNGNMALNGAEVDDFSWEPPTEAETKVLQARRERQDRISRLMGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 760134 - protein, 225 aa, Homo sapiens; identical to SEQ ID NO: 760133

SEQ ID NO: 760135 - protein, 200 aa, Homo sapiens
SRSPNGAEVDDFSWEPPTEAETKVLQARRERQDRISRLMGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 760136 - protein, 304 aa, Homo sapiens
MERAEPQRRALRFDVTSCEPGGDNGNMALNGAEVDDFSWEPPTEAETKVLQARRERQDRISRLMGDYLLRGYRMLGETCADCGTILLQDKQRKIYCVACQELDSDVDKDNPGGCGSVDMSLLCQLWGLYESIQDYKHLCQDLSFCQDLSSSLHSDSSYPPDAGLSDDEEPPDASLPPDPPPLTVPQTHNARDQWLQDAFHISLLKGWGAGGMHPCKRLRNSPSGKPSDFGACAFPPTAHLTGGPGMYSSEATLPNSFSCLGWLALGRASSVQPLLMALRPPVLPHVCTPSLASLSSRGARRISY

SEQ ID NO: 760137 - protein, 225 aa, Homo sapiens; identical to SEQ ID NO: 760133

SEQ ID NO: 760138 - protein, 162 aa, Homo sapiens
MGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 760139 - protein, 162 aa, Homo sapiens; identical to SEQ ID NO: 760138

SEQ ID NO: 760140 - protein, 274 aa, Homo sapiens
SSTCWPLDTSVTMWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 760141 - protein, 274 aa, Homo sapiens; identical to SEQ ID NO: 760140

SEQ ID NO: 760142 - protein, 162 aa, Homo sapiens
SSTCWPLDTSVTMWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLSHFQMISSVWTSKSCLMMSAKKPTSRR

SEQ ID NO: 760143 - protein, 271 aa, Homo sapiens
MYGSGYGIFTCRSGSVLACPLGGLGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 760144 - protein, 83 aa, Homo sapiens
PGLPAETGPPPLFLISLPGKTLKEQRCGRHILDGVSPSAGTGHPLFLISLPEKTLKEQRCGRLILLETGFHRVGQDGLNLLKS

SEQ ID NO: 760145 - protein, 544 aa, Homo sapiens
NNPRDDIATEAYEDELDMGRSGSYLNSSINSAWSEHSLDPEDIRDELKKLYAQLEIYKRKKMITNNPHLQKKRCSKKGLGRSIMRRITEIPETVSRQCSKEDKEGADHGTAKGTALIRKNPPESSGNTGKSKEETLKNRVFSLKKSHSTYDHVRDQTEESSSLPTESQEEETTENSTLESLSGKKLTQKLKEDSEAESTESVPLVCKSASAHNLSSEKKTGHPRTSMLQKSLSVIASAKEKTLGLAGKTQTAGVEERTKSQKPLPKDKETNRNHSNSDNTETKDPAPQNSNPAEEPRKPQKSGIMKQQRVNPTTANSDLNPGTTQMKDNFDIGEVCPWEVYDLTPGPVPSESKVQKHVSIVASEMEKNPTFSLKEKSHHKPKAAEVCQQSNQKRIDKAEVCLWESQGQSILEDEKLLISKTPVLPERAKEENGGQPRAANVCAGQSEELPPKAVASKTENENLNQIGHQEKKTSSSEENVRGSYNSSNNFQQPLTSRAEVCPWEFETPAQPNAGRSVALPASSALSANKIAGPRKEEIWDSFKV

SEQ ID NO: 760146 - protein, 172 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNVH

SEQ ID NO: 760147 - protein, 140 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKVIHSINVT

SEQ ID NO: 760148 - protein, 253 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNELQAHVDQITEMAAVMRKAIEIDEQQGCKEQERIFQLEQENKGLREILQITRESFLNLRKDDASESTSLSALVTNSDLSLRKS

SEQ ID NO: 760149 - protein, 253 aa, Homo sapiens; identical to SEQ ID NO: 760148

SEQ ID NO: 760150 - protein, 215 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKELQAHVDQITEMAAVMRKAIEIDEQQGCKEQERIFQLEQENKGLREILQITRESFLNLRKDDASESTSLSALVTNSDLSLRKS

SEQ ID NO: 760151 - protein, 253 aa, Homo sapiens; identical to SEQ ID NO: 760148

SEQ ID NO: 760152 - protein, 453 aa, Homo sapiens
MPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGVGGSTTVTTRKTWGSPALVPGHGGGGGVVGGGQENGVRVGPGDGTMVDSKELGMRGRGGEIPELLQKIPKGEGRAAARTSEKEDGVNHYPNFSKGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPKKNRGPERRPPRPAA

SEQ ID NO: 760153 - protein, 573 aa, Homo sapiens
DAGAVCDGMPLGYVPPTAPTDSNNSTPREAASRPPSTMTSQAPGTAGVSPPPASPTVLWEPGPEAGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGVGGSTTVTTRKTWGSPALVPGHGGGGGVVGGGQENGVRVGPGDGTMVDSKELGMRGRGGEIPELLQKIPKGEGRAAARTSEKEDGVNHYPNFSKGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPKKNRGPERRPPRPAA

SEQ ID NO: 760154 - protein, 615 aa, Homo sapiens
PGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGVGGSTTVTTRKTWGSPALVPGHGGGGGVVGGGQENGVRVGPGDGTMVDSKELGMRGRGGEIPELLQKIPKGEGRAAARTSEKEDGVNHYPNFSKGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPKKNRGPERRPPRPAA

SEQ ID NO: 760155 - protein, 401 aa, Homo sapiens
TGDLEDPVYRASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPKKNRGPERRPPRPAA

SEQ ID NO: 760156 - protein, 303 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGRVDKLALAEPGQYRCHSPPKVRRENHLPVTYA

SEQ ID NO: 760157 - protein, 351 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760158 - protein, 351 aa, Homo sapiens; identical to SEQ ID NO: 760157

SEQ ID NO: 760159 - protein, 334 aa, Homo sapiens
MLETLRERLLSVQQDFTSGLKTLSDKSREAKVKSKPRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760160 - protein, 224 aa, Homo sapiens
IESFLSMCRVGVSHMRILCPASGENEKILPRFYACLRGEGQGEAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760161 - protein, 168 aa, Homo sapiens [sequence omitted]

SEQ ID NO: 760162 - protein, 286 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALDTDREATPDGGEDSDS

SEQ ID NO: 760163 - protein, 150 aa, Homo sapiens
MFTFFRLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKS

SEQ ID NO: 760164 - protein, 195 aa, Homo sapiens
MSSPGLTENSQRDPSELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760165 - protein, 351 aa, Homo sapiens; identical to SEQ ID NO: 760157

SEQ ID NO: 760166 - protein, 316 aa, Homo sapiens
MLETLRERLLSVQQDFTSGYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760167 - protein, 270 aa, Homo sapiens
MLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 760168 - protein, 279 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALASRFQIPQN

SEQ ID NO: 760169 - protein, 255 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDGGEDSDS

SEQ ID NO: 760170 - protein, 104 aa, Homo sapiens
MGRRKHFNLQNDFYHKLNILVTFWSSALVKVVSPWSSDSCWSSEDLPPPCTLPCSLVLWCSPIPGSMWDVRTQDQDACTHQNGAFSFSLSQDLRESKKQTNTNK

SEQ ID NO: 760171 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALRAQKEAISPPDAASAAPLRTITADTFRKLFRVYSNFLRGKLKLYTGEACRTGDR

SEQ ID NO: 760172 - protein, 918 aa, Homo sapiens
PAPEFPGEAAAARRHRGGCGALGAPRARGPGSSVCAPARAGAPGPPDTMNHLNVLAKALYDNVAESPDELSFRKGDIMTVLEQDTQGLDGWWLCSLHGRQGIVPGNRLKILVGMYDKKPAGPGSGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 760173 - protein, 92 aa, Homo sapiens
GSHLLCVSPHVPAWGGCVPHMPACTTGPGWVTRRGWSVRVLQPAGPRATPRAEPGPTRVPCPLTGPVQFGVSSALPGEEPEELFFVIGFPII

SEQ ID NO: 760174 - protein, 870 aa, Homo sapiens [sequence omitted]

SEQ ID NO: 760175 - protein, 740 aa, Homo sapiens
LNREPGGGGVWAQCARGLENPTREALTSPRQGDLQGRRLPGMAPTRFRLVLVRGPVALGRPLCCLPLHPLCGPWLPGLWVMVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 760176 - protein, 870 aa, Homo sapiens [sequence omitted]

SEQ ID NO: 760177 - protein, 221 aa, Homo sapiens
LQGKEEFEKTQKVDVVIVLLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 760178 - protein, 96 aa, Homo sapiens
LNREPGGGGVWAQCARGLENPTREALTSPRQGDLQGRRLPGMAPTRFRLVLVRGPVALGRPLCCLPLHPLCGPWLPWALGHGKSTWGGEGWPWTHF

SEQ ID NO: 760179 - protein, 896 aa, Homo sapiens
HLVVSGEGMHCPGEAPLAAPRPTPKDPCLRNVLAKALYDNVAESPDELSFRKGDIMTVLEQDTQGLDGWWLCSLHGRQGIVPGNRLKILVGMYDKKPAGPGSGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 760180 - protein, 471 aa, Homo sapiens
MIIRNEGQTVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 760181 - protein, 219 aa, Homo sapiens
PKQPGACSPAPPRPMAGPATQSPMKLMALQLLLWHSALWTVQEATPLGPASSLPQSFLLKCLEQVRKIQGDGAALQEKLVCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 760182 - protein, 249 aa, Homo sapiens
MSPEPALSPALQLLLWHSALWTVQEATPLGPASSLPQSFLLKCLEQVRKIQGDGAALQEKLVCATYKLCHPEELVLLGHSLGIPWAPLSSCPSQALQLVVSGKDKANEEGEGEEEHPWAPPCLQVPSWGPDVSQAAPPNSSALSHRAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 760183 - protein, 67 aa, Homo sapiens
MDRAQYTGPAGCLSQLHSGLFLYQGLLQALEGISPELGPTLDTLQLDVADFATTIWQQVSLVGQGGQ

SEQ ID NO: 760184 - protein, 169 aa, Homo sapiens
MAGPATQSPMKLMALQLLLWHSALWTVQEATPLGPASSLPQSFLLKCLEQVRKIQGDGAALQEKLVAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 760185 - protein, 108 aa, Homo sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 760186 - protein, 100 aa, Homo sapiens
MLVEAWVYSAERELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 760187 - protein, 352 aa, Homo sapiens
WYRPEFGMAGERPTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 760188 - protein, 485 aa, Homo sapiens
RRVPGTWERGARLEPAGRRLQLGRVFRDARTESGGGAAPAPALRNGDALAPARLGSRRGLRCPRRGPGLSGRAQRLGGSGGAPRAGGGCSDPESAPSAGSRSGLRPRAPLRPEQVGVGRSHCRRPRGLACGRLRAARGGGSVLRARTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 760189 - protein, 346 aa, Homo sapiens
LVRSEFGTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 760190 - protein, 343 aa, Homo sapiens
GAGGGRLRRRRSGSPGWRAPRTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQWPP

SEQ ID NO: 760191 - protein, 386 aa, Homo sapiens
IRGEGAVSSEPTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 760192 - protein, 360 aa, Homo sapiens
GAGGGRLRRRRSGSPGWRAPRTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 760193 - protein, 337 aa, Homo sapiens
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 760194 - protein, 343 aa, Homo sapiens; identical to SEQ ID NO: 760190

SEQ ID NO: 760195 - protein, 135 aa, Homo sapiens
LGSTLSVQELSGIWVASCTVKESVTQASHRWHTYRLGLILDSCSEQSGRRQRHKPCERCVWNHLVSKSHVIPRSKETGWIWGWSGMKKHLSASEGCMAHGSISIMPCPFAHLVLLVVTSLVTGKVSKDIGVEHPG

SEQ ID NO: 760196 - protein, 448 aa, Homo sapiens
LEDLCYHRHPAEHSVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 760197 - protein, 421 aa, Homo sapiens
PLGPSSSFFSTPTRARSKLPSGKNILVFDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 760198 - protein, 255 aa, Homo sapiens
MSSTLRLYVFDFVSSCSELIFLEQIDSDGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 760199 - protein, 129 aa, Homo sapiens [sequence omitted]

SEQ ID NO: 760200 - protein, 500 aa, Homo sapiens
AGGAAVGKMAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 760201 - protein, 500 aa, Homo sapiens; identical to SEQ ID NO: 760200

SEQ ID NO: 760202 - protein, 500 aa, Homo sapiens; identical to SEQ ID NO: 760200

SEQ ID NO: 760203 - protein, 481 aa, Homo sapiens
AGGAAVGKMAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGTEGPWRLVTLVVE

SEQ ID NO: 760204 - protein, 318 aa, Homo sapiens
AGGAAVGKMAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFM

SEQ ID NO: 760205 - protein, 172 aa, Homo sapiens [sequence omitted]

SEQ ID NO: 760206 - protein, 251 aa, Homo sapiens
AGGAAVGKMAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCNPLMSRKKT

SEQ ID NO: 760207 - protein, 500 aa, Homo sapiens; identical to SEQ ID NO: 760200

SEQ ID NO: 760208 - protein, 500 aa, Homo sapiens; identical to SEQ ID NO: 760200

SEQ ID NO: 760209 - protein, 500 aa, Homo sapiens; identical to SEQ ID NO: 760200

SEQ ID NO: 760210 - protein, 196 aa, Homo sapiens
MALRRLSLVALVAWLLGGGGGDPSSILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 760211 - protein, 500 aa, Homo sapiens; identical to SEQ ID NO: 760200

SEQ ID NO: 760212 - protein, 500 aa, Homo sapiens; identical to SEQ ID NO: 760200

SEQ ID NO: 760213 - protein, 404 aa, Homo sapiens
AGGAAVGKMAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPWVLGEPGR

SEQ ID NO: 760214 - protein, 712 aa, Homo sapiens
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 760215 - protein, 712 aa, Homo sapiens; identical to SEQ ID NO: 760214

SEQ ID NO: 760216 - protein, 729 aa, Homo sapiens
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 760217 - protein, 712 aa, Homo sapiens; identical to SEQ ID NO: 760214

SEQ ID NO: 760218 - protein, 712 aa, Homo sapiens; identical to SEQ ID NO: 760214

SEQ ID NO: 760219 - protein, 712 aa, Homo sapiens; identical to SEQ ID NO: 760214

SEQ ID NO: 760220 - protein, 563 aa, Homo sapiens
SGGDFAARGAAGGDRQEPSSPSHLPISAALLRLSGFWILRCPGNYPGPPLASPAPAGIHRLVAGREGEKRERKGLILLLPPPLLLLLQPLPEGGKGEELGKASIMASDCEPALNQAEGRNPTLERYLGDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 760221 - protein, 240 aa, Homo sapiens
FRVDPLVRKCGVSSGPRLPEHRAGRRLRRSGPQPVGQGEHHGLGLRASSEPGRGPKPHPGALPGTALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 760222 - protein, 611 aa, Homo sapiens
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPAFRGFFASGTAARFVGPPFIL

SEQ ID NO: 760223 - protein, 100 aa, Homo sapiens
MIAHTPYEVTKAVKAGDIDAKTRRRIFDAVGFTFPNRLLTTKEAPDGCPDHVLRALGVALLACFCSDPELAAHPQVLNKIPILSTFLTARGDPDDAARRS

SEQ ID NO: 760224 - protein, 712 aa, Homo sapiens; identical to SEQ ID NO: 760214

SEQ ID NO: 760225 - protein, 729 aa, Homo sapiens; identical to SEQ ID NO: 760216

SEQ ID NO: 760226 - protein, 712 aa, Homo sapiens; identical to SEQ ID NO: 760214

SEQ ID NO: 760227 - protein, 712 aa, Homo sapiens; identical to SEQ ID NO: 760214

SEQ ID NO: 760228 - protein, 712 aa, Homo sapiens; identical to SEQ ID NO: 760214

SEQ ID NO: 760229 - protein, 464 aa, Homo sapiens
ISKAGSFEQSDLVTKAEPCKARQPRGKLHDLDDALGIQLTELVPQPQIQLHAVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 760230 - protein, 136 aa, Homo sapiens
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPIGGGH

SEQ ID NO: 760231 - protein, 92 aa, Homo sapiens
LLHLKGVLWQQVGSEKQKEPFVFASVRILGAWLAEETSSLRKEVCQLLPFLVRYAKTLYEEAEEANDLSQQVANLAISPTTPGPTWPGDALR

SEQ ID NO: 760232 - protein, 144 aa, Homo sapiens
MLIPEGKTTAGKDTKNDEGWFRSRKDLTPPLLMIIPGKGFLVLCNPKGRNSPMGGRILLGMKKFLFPCHECPAREQGGSVREGLSSWRKWDSKSRMLRLSGSQRGGSKCGMWVALWFSGSVVVPSTADFMTPHLSPSHIVYPSV

SEQ ID NO: 760233 - protein, 230 aa, Homo sapiens
MNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 760234 - protein, 677 aa, Homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 760235 - protein, 364 aa, Homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLV

SEQ ID NO: 760236 - protein, 677 aa, Homo sapiens; identical to SEQ ID NO: 760234

SEQ ID NO: 760237 - protein, 677 aa, Homo sapiens; identical to SEQ ID NO: 760234

SEQ ID NO: 760238 - protein, 576 aa, Homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFIG

SEQ ID NO: 760239 - protein, 296 aa, Homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKVSNFFSFVFLFLI

SEQ ID NO: 760240 - protein, 52 aa, Homo sapiens
LCGGEGPSLGPGVIISATAGPSQAGKLLPELVSPLQVKPGLGHSYFISCAGR

SEQ ID NO: 760241 - protein, 34 aa, Homo sapiens
NLSILVSGGDVRLAWGFVSALGSFPTRLTLKEQP

SEQ ID NO: 760242 - protein, 358 aa, Homo sapiens
MDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760243 - protein, 428 aa, Homo sapiens
LSVTRWLFLLVRSKMAASIVRRGMLLARQVVLPQLSPAGKRYLLSSAYVDSHKWEAREKEHYCLADLASLMDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760244 - protein, 358 aa, Homo sapiens; identical to SEQ ID NO: 760242

SEQ ID NO: 760245 - protein, 358 aa, Homo sapiens; identical to SEQ ID NO: 760242

SEQ ID NO: 760246 - protein, 388 aa, Homo sapiens
MAASIVRRGMLLARQVVLPQLSPAADLASLMDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760247 - protein, 517 aa, Homo sapiens
QGTLRRVGVGFMCQSAVSPEPCPAGEYGEREVLASRSGLAVPVPPLFVLVADCARELLGEGPSVRAVSQRRGRGGRQCSCLGPAPAVRPEGPGANVRTPPRSALSAASQGRCQFHRGEEETGREPHFPFRPKSFLSDCCSTSDSTIGSSAYIETDLASLMDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760248 - protein, 428 aa, Homo sapiens; identical to SEQ ID NO: 760243

SEQ ID NO: 760249 - protein, 428 aa, Homo sapiens; identical to SEQ ID NO: 760243

SEQ ID NO: 760250 - protein, 428 aa, Homo sapiens; identical to SEQ ID NO: 760243

SEQ ID NO: 760251 - protein, 168 aa, Homo sapiens
MPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760252 - protein, 428 aa, Homo sapiens; identical to SEQ ID NO: 760243

SEQ ID NO: 760253 - protein, 144 aa, Homo sapiens
PTLTLQREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760254 - protein, 195 aa, Homo sapiens [sequence omitted]

SEQ ID NO: 760255 - protein, 164 aa, Homo sapiens
LRARHPTPPESKVEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 760256 - protein, 144 aa, Homo sapiens; identical to SEQ ID NO: 760253

SEQ ID NO: 760257 - protein, 109 aa, Homo sapiens
EIYRLGSEAGWRRSKMAASIVRRGMLLARQVVLPQLSPAGKRYLLSSAYVDSHKWEAREKEHYCLADLASLMDKTFERKLPVSSLTISRLIDNISSREEIDHAEYYLYK

SEQ ID NO: 760258 - protein, 112 aa, Homo sapiens
MAASIVRRGMLLARQVVLPQLSPAGKRYLLSSAYVDSHKWEAREKEHYCLADLASLMDKTFERKLPVSSLTISRLIDNISSREEIDHAEYYLYKWNFTRCELLCTYFQLTLF

SEQ ID NO: 760259 - protein, 853 aa, Homo sapiens [sequence omitted]

SEQ ID NO: 760260 - protein, 851 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKVFFFFRTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 760261 - protein, 845 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 760262 - protein, 845 aa, Homo sapiens; identical to SEQ ID NO: 760261

SEQ ID NO: 760263 - protein, 125 aa, Homo sapiens
SADLGPILRLFLRLFKPCLQVLFYSGALGTELSQKCSVASTEPLWSVNPQQCQSYKSRAGLHSTFPTSPLPPCHLLLQAVVLFHADSHPASCLPFPSTEKADGTGQPTTLESAASLSGRGVLVNI

SEQ ID NO: 760264 - protein, 100 aa, Homo sapiens
GPGRVVGSRRRPPRKLVPLAYKQFSPNVPEKTLGASGRYEGKIARSSERFKELTPNYNPHSSRHIQRLLLSVGRVLCSGQCDRSAGDWGRWVGCACHPPG

SEQ ID NO: 760265 - protein, 317 aa, Homo sapiens
ENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 760266 - protein, 317 aa, Homo sapiens; identical to SEQ ID NO: 760265

SEQ ID NO: 760267 - protein, 102 aa, Homo sapiens
RRKLQKQALGPEQNLETLLNLATSVFYNRDQEEQVQKEKRDQRKAAALVMALRQTNLGGSERTEHEAGQSPGKACYQCGLLGHFKKDCPMRNKLPPRPCPLC

SEQ ID NO: 760268 - protein, 102 aa, Homo sapiens; identical to SEQ ID NO: 760267

SEQ ID NO: 760269 - protein, 199 aa, Homo sapiens
VSIGHFVREAAAPPLLSRPRLFLRLLLRLFLPPPGFRRRHSSLIPTPGRSVFLFISVFSPLQPPDKVIRAGPAGILSPHRPHTSIACPLSRTSNLSTPLLMQLRVTTYSRQGLEDYIHIRIQQRNGRKTLTTVQGIADDYDKKKLVKAFKKKFACNGTVIEHPEYGEVIQLQGDQRKNICQFLLEVGIVKEEQLKVHGF

SEQ ID NO: 760270 - protein, 215 aa, Homo sapiens
PDALSDALSVGDALSVGDALSVGGEAAAPPLLSRPRLFLRLLLRLFLPPPGFRRRHSSLIPTPGRSVFLFISVFSPLQPPDKVIRAGPAGILSPHRPHTSIACPLSRTSNLSTPLLMQLRVTTYSRQGLEDYIHIRIQQRNGRKTLTTVQGIADDYDKKKLVKAFKKKFACNGTVIEHPEYGEVIQLQGDQRKNICQFLLEVGIVKEEQLKVHGF

SEQ ID NO: 760271 - protein, 207 aa, Homo sapiens
PDALSDALSVGDALSVGDALSVGGEAAAPPLLSRPRLFLPPPGFRRRHSSLIPTPGRSVFLFISVFSPLQPPDKVIRAGPAGILSPHRPHTSIACPLSRTSNLSTPLLMQLRVTTYSRQGLEDYIHIRIQQRNGRKTLTTVQGIADDYDKKKLVKAFKKKFACNGTVIEHPEYGEVIQLQGDQRKNICQFLLEVGIVKEEQLKVHGF

SEQ ID NO: 760272 - protein, 199 aa, Homo sapiens; identical to SEQ ID NO: 760269

SEQ ID NO: 760273 - protein, 199 aa, Homo sapiens; identical to SEQ ID NO: 760269

SEQ ID NO: 760274 - protein, 102 aa, Homo sapiens
MSTIQNLQSFGKIPSPPPPSLARRASRPFARLATAPRGPLSALPAPLVGLCLGAQKMATGPLATPSPRTAPDSEPSSRSPGRGPCATPCPVLDPALASASAP

SEQ ID NO: 760275 - protein, 199 aa, Homo sapiens; identical to SEQ ID NO: 760269

SEQ ID NO: 760276 - protein, 199 aa, Homo sapiens; identical to SEQ ID NO: 760269

SEQ ID NO: 760277 - protein, 193 aa, Homo sapiens
VSIGHFVREAAAPPLLSRPRLFLRLLLRLFLPPPGFRRRHSSLIPTPGRSVFLFISVFSPLQPPDKVIRAGPAGILSPHRPHTSIACPLSRTSNLSTPLLMQLRVTTYSRQGLEDYIHIRIQQRNGRKTLTTVQGIADDYDKKKLVKAFKKKFACNGTVIEHPEYGEVIQLQGDQRKNICQFLLEVSDWVLYV

SEQ ID NO: 760278 - protein, 2540 aa, Homo sapiens
RAQSSRAHLGLPLRLHLRLCPGGATPSRRGPQQSRAVSLAPAAQSGPGAMGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWRTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHAVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 760279 - protein, 2540 aa, Homo sapiens; identical to SEQ ID NO: 760278

SEQ ID NO: 760280 - protein, 623 aa, Homo sapiens
MATVLSRALKLPGKKSPDLGEYDPLTQADSDESEDDLVLNLQKNGGVKNGKSPLGEAPEPDSDAEVAEAAKPHLSEVTTEGYPSEPLGGLEQKAASSLVSYVRTSVFLLTLGISMILVLLCAFLIPCPPRDLHSTWSRHLGSQGEVGTCLHWNWLMWNGDGLRDVLLSFVMSRNGSAVGVSRPAANLVCLSGMNGSTLWSSLLPEEARDITCLELMPGSLAETICLVTGTHKMLSAFNATSGKAIWTLNPNYLSNGTLAAPVVVLPDLDEDGVRDLVVLAIGELQPDLCFLLVSGRTGNPVGRPVKYNIVGVGNLIGPQVYITTNGAVYILFGFGNIQAVALRDIFVQAQNRDSSPPSLQIEEPEWEKRRSINLSELIDVYSDGVELLQMVKAPDSNCSNLLITTRQSLVLLRGQNLTPYWALRLQGLRSQPTPGYFTDDQTLDFLLQIQDGVGMKKMMVVDGDSGSIVWSYRAPCHMKETPATSAVTSDQKSVFLFWAEGLSAASPNSDIILGTEPPSLHHLYLLHPAFPSILLDLANTTGTVTASEVGINDLWKDAFYVTRTTGPSSEGHPAALVVSKLSLRWALMEGQMAQLQESTPKIGRGELRRFLSRIKFVEAPYEI

SEQ ID NO: 760281 - protein, 157 aa, Homo sapiens
MERSPSRRRRLEEAPKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 760282 - protein, 72 aa, Homo sapiens
SYASEAVLRLSGPPIPLKRVRHLAMPPTRDPFQQPTLDNDDSYLGELRASKNQDPIPWRIFNPSHSTHHFPG

SEQ ID NO: 760283 - protein, 154 aa, Homo sapiens
SYASEAVLRLSGPPIPLKRVRHLAMPPTRDPFQQPTLDNDDSYLGELRASKIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 760284 - protein, 494 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGKLVGMGGHLGGRLMGQPQNPGAGRATGTHSFIHSFIQHVFIQCLLWTSHCATSVIPG

SEQ ID NO: 760285 - protein, 631 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQNPFMATMAQLQSPHALYSHKPEVAQYTHTGLLPQTMLITDTTNLSALASLTPTKQVFTSDTEASSESGLHTPASQATTLHVPSQDPAGIQHLQPAHRLSASPTVSSSSLVLYQSSDSSNGQSHLLPSNHSVIETFISTQMASSSQ

SEQ ID NO: 760286 - protein, 270 aa, Homo sapiens
RLGSEAGCREDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETRWGAQQNAVRGPGHQDRITPP

SEQ ID NO: 760287 - protein, 829 aa, Homo sapiens
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDRHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 760288 - protein, 829 aa, Homo sapiens; identical to SEQ ID NO: 760287

SEQ ID NO: 760289 - protein, 463 aa, Homo sapiens
MEFCSVTRLKCSGVILAHCNLCLLSSWNYRCPPPYPASFFVFLVETGFHHVGQAGLELLTTDPPTSASQSAGITGMSQCAWPFLGFFRIFHFSYKVAFYHEENVLAEKHMPQKKKNQFFTIFPACLGKRPPLSKVGCAWLFFVIKQASNGQFSFSLTQKHVAEAGIKSCLLTSVSILAPGKIREPPLLGPLIPPGRGGSSSCEGPQFYSCYLTLVLVLSNVIWVKTILQAKVLIFYKMYNKKAIKVFLFLYFSNTPQDTILEGELGGTVIMLIVGATESILIKLNACRFLGEFSFVNNLALPEFFSEQTSPMRVNNDLDSNLYEVKNLQISYFELFSLVSSVVTPFYVSNHLCSEFSLWLLKKWAQSQRTHFTVPLEYISHCWTEANKTNCANHKQKRLLSVVASAISVSLPATKICHGLGNSMIPYCNFHPHRLACQRSEVNIHCCLKQMLCLTEHLTFKIA

SEQ ID NO: 760290 - protein, 829 aa, Homo sapiens; identical to SEQ ID NO: 760287

SEQ ID NO: 760291 - protein, 829 aa, Homo sapiens; identical to SEQ ID NO: 760287

SEQ ID NO: 760292 - protein, 789 aa, Homo sapiens
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDRHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQLLICLLQQGFGFQVPGLNFKIEAAIRGDLWEL

SEQ ID NO: 760293 - protein, 682 aa, Homo sapiens
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYKGEHCVKSFSWSSHLQINQRAHAGEKPYKCEKCDNAFRRFSSLQAHQRVHSRAKSYTNDASYRSFSQRSHLPHHQRVPTGENPYKYEECGRNVGKSSHCQAPLIVHTGEKPYKCEECGVGFSQRSYLQVHLKVHTGKKPYKCEECGKSFSWRSRLQAHERIHTGEKPYKCNACGKSFSYSSHLNIHCRIHTGEKPYKCEECGKGFSVGSHLQAHQISHTGEKPYKCEECGKGFCRASNLLDHQRGHTGEKPYQCDACGKGFSRSSDFNIHFRVHTGEKPYKCEECGKGFSQASNLLAHQRGHTGEKPYKCGTCGKGFSRSSDLNVHCRIHTGEKPYKCERCGKAFSQFSSLQVHQRVHTGEKPYQCAECGKGFSVGSQLQAHQRCHTGEKPYQCEECGKGFCRASNFLAHRGVHTGEKPYRCDVCGKRFRQRSYLQAHQRVHTGERPYKCEECGKVFSWSSYLQAHQRVHTGEKPYKCEECGKGFSWSSSLIIHQRVHADDEGDKDFPSSEDSHRKTR

SEQ ID NO: 760294 - protein, 812 aa, Homo sapiens
MFQAHLQTFNLAEIIHATDLCTCLELRDTVKRLQVAFCLLKTPENHPSGLWNSTQLNQDFAVNVYIFCSLSYISQYSVHVLLKLWGVRSELAQQASMARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 760295 - protein, 812 aa, Homo sapiens; identical to SEQ ID NO: 760294

SEQ ID NO: 760296 - protein, 716 aa, Homo sapiens
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 760297 - protein, 716 aa, Homo sapiens; identical to SEQ ID NO: 760296

SEQ ID NO: 760298 - protein, 888 aa, Homo sapiens
MDESALLDLLECPVCLERLDASAKVLPCQHTFCKRCLLGIVGSRNELRCPECRTLVGSGVEELPSNILLVRLLDGIKQRPWKPGPGGGSGTNCTNALRSQSSTVANCSSKDLQSSQGGQQPRVQSWSPPVRGIPQLPCAKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 760299 - protein, 556 aa, Homo sapiens
RLVRGRVESAEGELSGFSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 760300 - protein, 348 aa, Homo sapiens
MDESALLDLLECPVCLERLDASAKVLPCQHTFCKRCLLGIVGSRNELRCPECRTLVGSGVEELPSNILLVRLLDGIKQRPWKPGPGGGSGTNCTNALRSQSSTVANCSSKDLQSSQGGQQPRVQSWSPPVRGIPQLPCAKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLIISVEPVPLWPVQQLLH

SEQ ID NO: 760301 - protein, 634 aa, Homo sapiens
WGDLEDPTEDEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 760302 - protein, 888 aa, Homo sapiens; identical to SEQ ID NO: 760298

SEQ ID NO: 760303 - protein, 137 aa, Homo sapiens [sequence omitted]

SEQ ID NO: 760304 - protein, 502 aa, Homo sapiens
RSAEHPGELSKLGKAHATREKLRVSKLLERQVRKVSVNVKTVRGSLERQAGQIKKLEVKRRPEALAFAVLPATFKVMIYQDEVKLPAKLSISKSAEQSRRPHPAGPARLRVAMEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 760305 - protein, 390 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 760306 - protein, 198 aa, Homo sapiens
MEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 760307 - protein, 390 aa, Homo sapiens; identical to SEQ ID NO: 760305

SEQ ID NO: 760308 - protein, 390 aa, Homo sapiens; identical to SEQ ID NO: 760305

SEQ ID NO: 760309 - protein, 390 aa, Homo sapiens; identical to SEQ ID NO: 760305

SEQ ID NO: 760310 - protein, 390 aa, Homo sapiens; identical to SEQ ID NO: 760305

SEQ ID NO: 760311 - protein, 152 aa, Homo sapiens
CESWCCSWALRHIISDGGCSCPGDVAKAFGAGADFVMLGGMLALSPPGIRVRMKKSSVSGMTAAGWVVWGEAEGKADFSKSRKLGSQKGAAAGWELGGRAGCRPCHQVESWRGGGERTSQSSQPWFTPGSFFSSSFPRSMVARACGLSYLGG

SEQ ID NO: 760312 - protein, 390 aa, Homo sapiens; identical to SEQ ID NO: 760305

SEQ ID NO: 760313 - protein, 170 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPRTPRAEF

SEQ ID NO: 760314 - protein, 390 aa, Homo sapiens; identical to SEQ ID NO: 760305

SEQ ID NO: 760315 - protein, 390 aa, Homo sapiens; identical to SEQ ID NO: 760305

SEQ ID NO: 760316 - protein, 390 aa, Homo sapiens; identical to SEQ ID NO: 760305

SEQ ID NO: 760317 - protein, 390 aa, Homo sapiens; identical to SEQ ID NO: 760305

SEQ ID NO: 760318 - protein, 390 aa, Homo sapiens; identical to SEQ ID NO: 760305

SEQ ID NO: 760319 - protein, 390 aa, Homo sapiens; identical to SEQ ID NO: 760305

SEQ ID NO: 760320 - protein, 390 aa, Homo sapiens; identical to SEQ ID NO: 760305

SEQ ID NO: 760321 - protein, 390 aa, Homo sapiens; identical to SEQ ID NO: 760305

SEQ ID NO: 760322 - protein, 305 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDQ

SEQ ID NO: 760323 - protein, 172 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQPGKHPISTKRSQRGE

SEQ ID NO: 760324 - protein, 764 aa, Homo sapiens
SSCTIPAFACAAAFLLHLFSSASAGAMGEPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNARSTTTTCPS

SEQ ID NO: 760325 - protein, 125 aa, Homo sapiens
GLNQAEMETKAVMETRLRKVTLEACVGQKTHSCRGTGVVLALGLSSSASSALPGHPDLASRAAGEQGTALGSAPRAVRRTHSASRGALHVTGSVIPQQGTLTAAPAWPALCILPPLPSPPAPQPC

SEQ ID NO: 760326 - protein, 244 aa, Homo sapiens
APSICDQPRRRVKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNARSTTTTCPS

SEQ ID NO: 760327 - protein, 214 aa, Homo sapiens
MWHQPLCPSRSASDDISLTVKGAGGIGFRLTSHLCSSRSLLKGLVTTHGHWLLPWTVQALSSQAILGQGLCQAPTWLVLQGGPPGALAADSWPIASQVQCQEYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 760328 - protein, 99 aa, Homo sapiens
MQCQAQLVHLCLALHVGFIVCKHLEPVMVHQHVHDVLEAVWLLGTNWYRNPKEWTKKVIRNIACSGKFSSDRTITEYAREIWGVEPSDLQIPPPNIPRD

SEQ ID NO: 760329 - protein, 764 aa, Homo sapiens; identical to SEQ ID NO: 760324

SEQ ID NO: 760330 - protein, 764 aa, Homo sapiens; identical to SEQ ID NO: 760324

SEQ ID NO: 760331 - protein, 764 aa, Homo sapiens; identical to SEQ ID NO: 760324

SEQ ID NO: 760332 - protein, 186 aa, Homo sapiens
MWHQPLCPSRSASDDISLTVKGAGGIGFRLTSHLCSSRSLLKGLVTTHGHWLLPWTVQALSSQAILGQGLCQAPTWLVLQGGPPGALAADSWPIASQEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 760333 - protein, 764 aa, Homo sapiens; identical to SEQ ID NO: 760324

SEQ ID NO: 760334 - protein, 746 aa, Homo sapiens
SSCTIPAFACAAAFLLHLFSSASAGAMGEPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEVVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNARSTTTTCPS

SEQ ID NO: 760335 - protein, 764 aa, Homo sapiens; identical to SEQ ID NO: 760324

SEQ ID NO: 760336 - protein, 764 aa, Homo sapiens; identical to SEQ ID NO: 760324

SEQ ID NO: 760337 - protein, 764 aa, Homo sapiens; identical to SEQ ID NO: 760324

SEQ ID NO: 760338 - protein, 764 aa, Homo sapiens; identical to SEQ ID NO: 760324

SEQ ID NO: 760339 - protein, 107 aa, Homo sapiens
YHAMMGASEVAQTLAKETFASTASQLHSNVVNYVQQIVAPKGSERLVCMAPASSGSPGFQNNCLFPNSCSLINFLEFISPQDNLFSSLGICDSWASALVGTYFSIAH

SEQ ID NO: 760340 - protein, 72 aa, Homo sapiens
NKQYELVENSAEASSVKVQCVCVYVCMCVRVSVPDPVSPTLPPVLRCFPETPLSWPVGHGKPPGWEAGPQVG

SEQ ID NO: 760341 - protein, 715 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 760342 - protein, 253 aa, Homo sapiens
MSSYMVNSKYVDPKFPPCEEYLQGGYLGEQGADYYGGGAQGADFQPPGLYPRPDFGEQPFGGSGPGPGSALPARGHGQEPGGPGGHYAAPGEPCPAPPAPPPAPLPGARAYSQSDPKQPPSGTALKQPAVVYPWMKKVHVNSVNPNYTGGEPKRSRTAYTRQQVLELEKEFHFNRYLTRRRRIEIAHTLCLSERQIKIWFQNRRMKWKKDHKLPNTKGRSSSSSSSSSCSSSVAPSQHLQPMAKDHHTDLTTL

SEQ ID NO: 760343 - protein, 253 aa, Homo sapiens; identical to SEQ ID NO: 760342

SEQ ID NO: 760344 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760345 - protein, 789 aa, Homo sapiens
AQALLTEDLGHTGAECTHRDMLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760346 - protein, 769 aa, Homo sapiens; identical to SEQ ID NO: 760344

SEQ ID NO: 760347 - protein, 769 aa, Homo sapiens; identical to SEQ ID NO: 760344

SEQ ID NO: 760348 - protein, 689 aa, Homo sapiens
ATLGYHAAISVSCVSTKATEKISLTHALLNSSRVGSPETAQFKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760349 - protein, 444 aa, Homo sapiens
MSLLMCGRGDPGAGQCGSAGRAPSCRLTLALGSEHQLFLLLVTTFLPTLNPPGPLQRPGGEGWELGCHPGHRGSPPEPSTALQITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760350 - protein, 711 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIPPSRGCFKYR

SEQ ID NO: 760351 - protein, 149 aa, Homo sapiens
NCSAACPGLQLSNNPVKGRSYQLPLCQECPGCPSPCGKYISCAECLKFEKGPFGKNCSQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760352 - protein, 221 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNHFPPSK

SEQ ID NO: 760353 - protein, 187 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVCVFPVQVRTSV

SEQ ID NO: 760354 - protein, 126 aa, Homo sapiens
EELRGTGSVRTLRPAPPAEVSRRDPGQTGSKAPTPSQEHRRGLQHTEGHAGPAPPTARPGGAALPRVRPLSGVHEVQGQQLPGMHRVGARLHLVPEAGSGFGSSSPRHRGEQSPEEKPGGSRLSSD

SEQ ID NO: 760355 - protein, 769 aa, Homo sapiens; identical to SEQ ID NO: 760344

SEQ ID NO: 760356 - protein, 840 aa, Homo sapiens
PRPAGGELHGWSAPGVGPETVTKTPSLHRTCWACAPHCSPWWGCSPSGAVSSVFHGGDSTRDIPIRENRACPHFPKTEVPGRLGKDLATGVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760357 - protein, 769 aa, Homo sapiens; identical to SEQ ID NO: 760344

SEQ ID NO: 760358 - protein, 425 aa, Homo sapiens
LEDLFCGCFPSLRIAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760359 - protein, 222 aa, Homo sapiens
AAAVPLCPSSLLCAPAAGPGIRLPVHPLHPHLPHLGPLLGLRAPQPHLPPLVDTHPSPSPRCRSPRTPWHRCSHLAPRSSCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 760360 - protein, 221 aa, Homo sapiens; identical to SEQ ID NO: 760352

SEQ ID NO: 760361 - protein, 135 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDT

SEQ ID NO: 760362 - protein, 149 aa, Homo sapiens
PRPAGGELHGWSAPGVGPETVTKTPSLHRTCWACAPHCSPWWGCSPSGAVSSVFHGGDSTRDIPIRENRACPHFPIDRSSREAGEGPCHWGPLSGVHEVQGQQLPGMHRVGARLHLVPEAGSGFGSSSPRHRGEQSPEEKPGGSRLSSD

SEQ ID NO: 760363 - protein, 351 aa, Homo sapiens
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 760364 - protein, 328 aa, Homo sapiens
IRLGTRLGVARRQLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 760365 - protein, 351 aa, Homo sapiens; identical to SEQ ID NO: 760363

SEQ ID NO: 760366 - protein, 209 aa, Homo sapiens
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 760367 - protein, 352 aa, Homo sapiens
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWLWVQAVNLSLSH

SEQ ID NO: 760368 - protein, 127 aa, Homo sapiens
MVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 760369 - protein, 209 aa, Homo sapiens; identical to SEQ ID NO: 760366

SEQ ID NO: 760370 - protein, 351 aa, Homo sapiens; identical to SEQ ID NO: 760363

SEQ ID NO: 760371 - protein, 1068 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760372 - protein, 103 aa, Homo sapiens
QGAHWCVGAGLGPCFTVGPPWTGCPAPKGSRSSSCPFCTVFRQLNTAIAVSQMSSGQCRLAPLIQVIQDCSHLYHYTVKLLFKLHSCEWPRATPGPEGCVYMA

SEQ ID NO: 760373 - protein, 883 aa, Homo sapiens
MRSRTRGVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760374 - protein, 639 aa, Homo sapiens
MALREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760375 - protein, 1143 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKVRAVTRGGLHLEGHQSLLSWSRQAIRLLVTTSTSLQKEIVESGRGAATQQEFYAKNSRWTEGLISASKAVGWGATQLVEVALGGGGQGAASCQLEQFGVQQGAGSRGGVELVPAVRGVRDPGPDWPLTRREAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760376 - protein, 250 aa, Homo sapiens
VNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760377 - protein, 196 aa, Homo sapiens
RTRGSTHAFGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760378 - protein, 880 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGQPSPEGQPS

SEQ ID NO: 760379 - protein, 195 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESGEP

SEQ ID NO: 760380 - protein, 221 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESGSLLSLQRFASGPITGKAGAGPEGPGHRS

SEQ ID NO: 760381 - protein, 915 aa, Homo sapiens
QGAHWCVGAGLGPCFTVGPPWTGCPAPKGSRSSSCPFCTVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760382 - protein, 1091 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKVRAVTRGGLHLEGHQSLLSWSRQAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 760383 - protein, 1068 aa, Homo sapiens; identical to SEQ ID NO: 760371

SEQ ID NO: 760384 - protein, 1068 aa, Homo sapiens; identical to SEQ ID NO: 760371

SEQ ID NO: 760385 - protein, 615 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERVWPPQMQQHH

SEQ ID NO: 760386 - protein, 110 aa, Homo sapiens
MGRGSGILSVAFWGTDSTRPSSCVVSADQALCGLEECRPLLLRPGPRASVMGAPQEGSDAGRGRFLGSEVRHSGPGAAFTPGVSISSWNLQPPPFPVFHSPVLAAPHCPP

SEQ ID NO: 760387 - protein, 80 aa, Homo sapiens
VLSADQATAAGGRERGWPESLAPLSFSIFVSVGFYGVRFLICSTTLCLLLSSGPSLWEIQVPIPTLSPKQSAGDVLGPQG

SEQ ID NO: 760388 - protein, 132 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGEGNCGKY

SEQ ID NO: 760389 - protein, 758 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760390 - protein, 758 aa, Homo sapiens; identical to SEQ ID NO: 760389

SEQ ID NO: 760391 - protein, 241 aa, Homo sapiens
SDLEELLLHGGQVFMADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760392 - protein, 232 aa, Homo sapiens
LIFAALHIALCCAFINFLFNGFGSTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760393 - protein, 712 aa, Homo sapiens
IRLVRGWVVRAMAVSAGSARTSPSSGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760394 - protein, 702 aa, Homo sapiens
VSSRGFRARNPRAQLRFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760395 - protein, 592 aa, Homo sapiens
SGLMDGPHGCNHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 760396 - protein, 316 aa, Homo sapiens [sequence omitted]

SEQ ID NO: 760397 - protein, 490 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRWARGAESGKK

SEQ ID NO: 760398 - protein, 465 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYQSRSGAQ

SEQ ID NO: 760399 - protein, 456 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVRCLMLTIYCSSEPPCALGSGFVLHTP

SEQ ID NO: 760400 - protein, 117 aa, Homo sapiens
LRYSRKLIHSQVKPYEIMFLAPFSSFLTSSRIQQFQDCNTSSVCLRVGEVENSGRRRIDRRGKGSTSLLYPLDKHNIEIWSNHKKSINQPHEKFSFSNSVGGICQITLERTEIVYHS

SEQ ID NO: 760401 - protein, 423 aa, Homo sapiens
GKGNQVLKLTSRAPLPPCTMPYNFCLPSLSCRTSCSSRPCVPPSCHGYTLPGACNIPANVSNCNWFCEGSFNGSEKETMQFLNDRLASYLEKVRQLERDNAELENLIRERSQQQEPLLCPSYQSYFKTIEELQQKILCSKSENARLVVQIDNAKLAADDFRTKYQTEQSLRQLVESDINSLRRILDELTLCRSDLEAQMESLKEELLSLKQNHEQEVNTLRCQLGDRLNVEVDAAPAVDLNQVLNETRNQYEALVETNRREVEQWFATQTEELNKQVVSSSEQLQSYQAEIIELRRTVNALEIELQAQHNLRYSLENTLTESEARYSSQLSQVQSLITNVESQLAEIRSDLERQNQEYQVLLDVRARLECEINTYRSLLESEDCKLPSNPCATTNACEKPIGSCVTNPCGPRSRCGPCNTFGY

SEQ ID NO: 760402 - protein, 124 aa, Homo sapiens
RGFCIEGGDRRKERKTRPFASYGLRGRVAMECRLVLGLAAWPTPGSGLSRGRSRHCDKEEKTSQGKGLTLLHPFFRLSTARLLASETVIRNCLSSLQGGHTRAESPWDISLEHQYYYSIWKTQI

SEQ ID NO: 760403 - protein, 101 aa, Homo sapiens
SRSSLSSSLSDMRSAAVPRGGLTAADLAVLRLLQGRSPLARVSISRQPTKVHLPLMACAGGLPWSAAWSSGSQRGPHLGRASHGDAPATVIKRRKRHRGRA

SEQ ID NO: 760404 - protein, 323 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 760405 - protein, 323 aa, Homo sapiens; identical to SEQ ID NO: 760404

SEQ ID NO: 760406 - protein, 163 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIIGVDPSYVVCHSVLPHKHPLD

SEQ ID NO: 760407 - protein, 879 aa, Homo sapiens
MHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLGTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 760408 - protein, 234 aa, Homo sapiens
MVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLGTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 760409 - protein, 137 aa, Homo sapiens
MSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRLVTHLLQLCAFQVSSGHSWCLWIHPKEVTSCRLPVQAV

SEQ ID NO: 760410 - protein, 649 aa, Homo sapiens
MHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRLVTHLLQLCAFQVSSGHSWCLWIHPKEVTSCRLPVQAV

SEQ ID NO: 760411 - protein, 73 aa, Homo sapiens
QPDYNQWFENISYEHFNNGGCIILDEVNEKPYNWWRIAIYFDLSFQRLCSMANELRRTSSKLRDYKYFFAISH

SEQ ID NO: 760412 - protein, 106 aa, Homo sapiens
PCLFLLCPCSVPPILILHRDQQEAVASFWVSLPTPCAHLCGTHSQRVPVSTRAVTSLCSELSCRSVSCGPTRPHHLSVLTPPGDLRAFARAGPSARSSLPSVCTGL

SEQ ID NO: 760413 - protein, 32 aa, Homo sapiens
RTFEQRVEDVRLIREQHPTKIPVIIERYKGEK

SEQ ID NO: 760414 - protein, 626 aa, Homo sapiens
MNVEVVKVMPQDLVTFKDVAIDFSQEEWQWMNPAQKRLYRSMMLENYQSLVSLGLCISKPYVISLLEQGREPWEMTSEMTRSPFSDWESIYVTQELPLKQFMYDDACMEGITSYGLECSTFEENWKWEDLFEKQMGSHEMFSKKEIITHKETITKETEFKYTKFGKCIHLENIEESIYNHTSDKKSFSKNSMVIKHKKVYVGKKLFKCNECDKTFTHSSSLTVHFRIHTGEKPYACEECGKAFKQRQHLAQHHRTHTGEKLFECKECRKAFKQSEHLIQHQRIHTGEKPYKCKECRKAFRQPAHLAQHQRIHTGEKPYECKECGKAFSDGSSFARHQRCHTGKRPYECIECGKAFRYNTSFIRHWRSYHTGEKPFNCIDCGKAFSVHIGLILHRRIHTGEKPYKCGVCGKTFSSGSSRTVHQRIHTGEKPYECDICGKDFSHHASLTQHQRVHSGEKPYECKECGKAFRQNVHLVSHLRIHTGEKPYECKECGKAFRISSQLATHQRIHTGEKPYECIECGNAFKQRSHLAQHQKTHTGEKPYECNECGKAFSQTSNLTQHQRIHTGEKPYKCTECGKAFSDSSSCAQHQRLHTGQRPYQCFECGKAFRRKLSLICHQRSHTGEEP

SEQ ID NO: 760415 - protein, 626 aa, Homo sapiens; identical to SEQ ID NO: 760414

SEQ ID NO: 760416 - protein, 422 aa, Homo sapiens
MVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECGKAFNQSSTLTTHKRIHSGEKPYKCEECGKAFKQFSNLTDHKKIHTGEKPYKCEECGKAFNQLSNLTRHKVIHTGEKPYKCGECGKAFNQSSALNTHKIIHTGENPHKCRESGKVFHLSSKLSTCKKIHTGEKLYKCEECGKAFN

SEQ ID NO: 760417 - protein, 77 aa, Homo sapiens
SLAAAGASGVVFTALCLLLLEAQLLWPRYHAGIGRSTAKTPGPTGSLDNGTIDIYGCGHRILFGGVAMPGHCTAEFI

SEQ ID NO: 760418 - protein, 378 aa, Homo sapiens
MVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECDKAFNLSSTLTKHKVIHTGEKLYKCKECGKAFKQFSHLAIHNIIHTGEKLYKCEECGKAFNSSSNLTAHKKNRTGEKPYKCEECGKANLSSTLTPHKTIHI

SEQ ID NO: 760419 - protein, 378 aa, Homo sapiens; identical to SEQ ID NO: 760418

SEQ ID NO: 760420 - protein, 378 aa, Homo sapiens; identical to SEQ ID NO: 760418

SEQ ID NO: 760421 - protein, 177 aa, Homo sapiens
KLTTHKKIHTGEKPYKCEKCAKAFSQSSTLSTYKIIHTGEKCYKCEECGKVFNRSSNLTDHKKIHTGEKSYKCEECDKAFNLSSTLTKHKVIHTGEKLYKCKECGKAFKQFSHLAIHNIIHTGEKLYKCEECGKAFNSSSNLTAHKKNRTGEKPYKCEECGKANLSSTLTPHKTIHI

SEQ ID NO: 760422 - protein, 285 aa, Homo sapiens
LATRKRSVVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760423 - protein, 271 aa, Homo sapiens
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760424 - protein, 285 aa, Homo sapiens; identical to SEQ ID NO: 760422

SEQ ID NO: 760425 - protein, 285 aa, Homo sapiens; identical to SEQ ID NO: 760422

SEQ ID NO: 760426 - protein, 285 aa, Homo sapiens; identical to SEQ ID NO: 760422

SEQ ID NO: 760427 - protein, 320 aa, Homo sapiens
LATRKRSVVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQVPSPSPLLSAGGVQWAHRAWGGVRRPGPDRHLCQQEVEPMCKESDHIHIIALAQALSVSIQVEYMDRGEGGTTNPHIFPEGSEPKVYLLYRPGHYDILYK

SEQ ID NO: 760428 - protein, 271 aa, Homo sapiens
RPWDVRGLRDLSLRPATFSGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760429 - protein, 306 aa, Homo sapiens
QQRHGQRMRRPPVVVKDRTRVRRCLKMAAEEPQQQKQEPLGSDSEGVNCLAYDEAIMAQQDRIQQEDMTDPCLLQIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760430 - protein, 350 aa, Homo sapiens
MKPSWLSRTEFSKRLLCRTLWCQSGWSSRSYTRSMLKMTTSINRRSRTSTKSTRTSARPGLTATVSIGLSDSPTWRHCWMTARSCSGEKGGHWAPRQVGVYLLPGRVGCVSSRVSPSFPGDGLDSGLARRGSAVSALASGLVEEPMLGPPFHPTPRFKAVSAKSKEDLVSQGFTEFTIEDFHNTVSPGACLGLGHGGGVHLVRTTHLLPVILPFLPPWLQFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760431 - protein, 297 aa, Homo sapiens
MKPSWLSRTEFSKRLLCRTLWCQSGWSSRSYTRSMLKMTTSINRRSSVSIGLSDSPTWRHCWMTARSCSGEKGGHWAPRQVGVYLLPGRVGCVSSRVSPSFPGDGLDSGLARRGSAVSALASGLVEEPMLGPPFHPTPRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760432 - protein, 320 aa, Homo sapiens; identical to SEQ ID NO: 760427

SEQ ID NO: 760433 - protein, 227 aa, Homo sapiens
EVTREAEVMVSLDHTIALQPGQEERNSISTKTKTKQNKTKQNKTKQNTTLERPKQVEDYEVQEIKIILANMVKPRLWSERTGPLGPIRTSSLRAPSPRSTFSTGLDTTISSTNRAGSSPLLPCCPPLPGARHVQRFFCGCKWSYFTPFFLSHDPPPCFIKGGAGGEPCVRVPALLPAWLLCLLPPPPRWVPLLFTYLLLSFPNRSRFEGPGLLEAPPASLGSASFPS

SEQ ID NO: 760434 - protein, 285 aa, Homo sapiens; identical to SEQ ID NO: 760422

SEQ ID NO: 760435 - protein, 297 aa, Homo sapiens
QQRHGQRMRRPPVVVKDRTRVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760436 - protein, 285 aa, Homo sapiens; identical to SEQ ID NO: 760422

SEQ ID NO: 760437 - protein, 279 aa, Homo sapiens
AVVPVRVVGIAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760438 - protein, 279 aa, Homo sapiens
RLYSPGSNGIAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760439 - protein, 314 aa, Homo sapiens
MKPSWLSRTEFSKRLLCRTLWCQSGWSSRSYTRSMLKMTTSINRRSRTSTKSTRTSARPGLTATVSIGLSDSPTWRHCWMTARSCSGEKGGHWAPRQVGVYLLPGRVGCVSSRVSPSFPGDGLDSGLARRGSAVSALASGLVEEPMLGPPFHPTPRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760440 - protein, 321 aa, Homo sapiens
LATRKRSVVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTVSPGACLGLGHGGGVHLVRTTHLLPVILPFLPPWLQFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760441 - protein, 280 aa, Homo sapiens
QQRHGQRMRRPPVVVKDRTRVRRCLKMAAEEPQQQKQEPLGSDSEGVNCLAYDEAIMAQQDRIQQEIAVQNPLVSERLELSVLYKEYAEDDNIYQQKIKCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 760442 - protein, 366 aa, Homo sapiens
CSQAERPTPGPSPPACSSGGPRREGLEFRWATEHKGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRWRSRPLSPTCWPPSMTRAPPTTLWSTCGCSPRATCSARASSSSTSSRVDGLSRSSASRRWSPCARRATTSTSLRWPRPSACPSRWSTWTAARAAPPIRTSSLRAPSPRSTFSTGLDTTISSTNRAGSSPLLPCCPPLPGARHVQRFFCGCKWSYFTPFFLSHDPPPCFIKGGAGGEPCVRVPALLPAWLLCLLPPPPRWVPLLFTYLLLSFPNRSRFEGPGLLEAPPASLGSASFPS

SEQ ID NO: 760443 - protein, 139 aa, Homo sapiens
QQRHGQRMRRPPVVVKDRTRVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQR

SEQ ID NO: 760444 - protein, 524 aa, Homo sapiens
ARRVASGEATLAMDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSREEALAGRAARQEAEALRGLVRGLELELRQERGLGHRVAGRRGQDCRRLAKELEEAKASERSLRARLKTLTSELALYKRGRRTPPVQPPPTREDRASSSRERSASRGRGAARSSSRESGRGSRGRGRPARPSPSPTGGRALRFDPTAFVKAKERKQREIQMKQQQRNRLGSGGSGDGPSVSWSRQTRPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 760445 - protein, 438 aa, Homo sapiens
MLASSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSREEALAGRAARQEAEALRGLVRGLELELRQERGLGHRVAGRRGQDCRRLAKELEEAKASERSLRARLKTLTSELALYKRGRRTPPVQPPPTREDRASSSRERSASRGRGAARSSSRESGRGSRGRGRPARPSPSPTGGRALRFDPTAFVKAKERKQREIQMKQQQRNRLGSGGSGDGPSVSWSRQTRPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 760446 - protein, 524 aa, Homo sapiens; identical to SEQ ID NO: 760444

SEQ ID NO: 760447 - protein, 216 aa, Homo sapiens
ARRVASGEATLAMDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSPG

SEQ ID NO: 760448 - protein, 258 aa, Homo sapiens
ARRVASGEATLAMDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPRPPSPLVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 760449 - protein, 195 aa, Homo sapiens
ARRVASGEATLAMDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRPAQSLPWPRPSCCPWGLRCVRP

SEQ ID NO: 760450 - protein, 98 aa, Homo sapiens
KALSMKVTGSISAFMMTFVYVFVGFYSDKHKTLHQVEPVLCDEAVEQKSSVAVCLFLLHIQLNANSDPFEMVNRLNPGIVSSLSIQTSSENHVVKLLD

SEQ ID NO: 760451 - protein, 433 aa, Homo sapiens
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 760452 - protein, 162 aa, Homo sapiens
RRIPDICGSGLFISAVNYVDMGLADTVMHTELTDYSTKCYPWLSITRIHCACMTPKKTSRDTCARMHGLHHDRMQKNASTFEDVTQVSSAYQKTVPVEAVTSKTSNIRANFENLAKEKEQEDRRKAEAERAQRMAKERQEQEEARRKLEEQARARTINIAVP

SEQ ID NO: 760453 - protein, 550 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760454 - protein, 513 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760455 - protein, 353 aa, Homo sapiens
MRLTVLKTYFPPVTCTTRYMWFWPFIVHVDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760456 - protein, 316 aa, Homo sapiens
MRLTVLKTYFPPVTCTTRYMWFWPFIVHVDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760457 - protein, 415 aa, Homo sapiens
MCSSSSGPRANCCPVSPDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760458 - protein, 417 aa, Homo sapiens
EDPPRSPYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760459 - protein, 353 aa, Homo sapiens; identical to SEQ ID NO: 760455

SEQ ID NO: 760460 - protein, 353 aa, Homo sapiens; identical to SEQ ID NO: 760455

SEQ ID NO: 760461 - protein, 258 aa, Homo sapiens
VVPGVLWIDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760462 - protein, 268 aa, Homo sapiens
MRALIHKVEAGQARVPARDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760463 - protein, 234 aa, Homo sapiens [sequence omitted]

SEQ ID NO: 760464 - protein, 401 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRLPSCPSSAVGTSQDKHEASGRPCGG

SEQ ID NO: 760465 - protein, 90 aa, Homo sapiens
KRSRHDVEDPPMTKLIRDLPGQARGLRSALWRVGRKDCPRRGASSRVSLLGRRGLGLMEVNPELSHPEHRSCHVRWEICLCHTVTARRIR

SEQ ID NO: 760466 - protein, 550 aa, Homo sapiens; identical to SEQ ID NO: 760453

SEQ ID NO: 760467 - protein, 571 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGRNSSPS

SEQ ID NO: 760468 - protein, 530 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIHELVA

SEQ ID NO: 760469 - protein, 366 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQGTVATSLLPSPRPSCAATSSTDFRAHRQHLQHSPPVSPLVSCQAVRHFKPISSRATLILSGSLSSL

SEQ ID NO: 760470 - protein, 320 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKGTFTLPVCEMVLEVCFCSLRGQLVCVVSACACCTLFCLHCLKLSCVPPQSPSSLQLV

SEQ ID NO: 760471 - protein, 276 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKGRRERCRKSPLRGPRWGESQPPEAVSPRSGGPDGESHSHLKPFPERWLLPQGGLCPPLHVSGSSGYHMMDVFPVTHPPRSPGICCHCGASPPCSGSRLPFIWAALLLEKRAHRLIGRKLTSPQG

SEQ ID NO: 760472 - protein, 241 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKGVFRFILPSSQQLVM

SEQ ID NO: 760473 - protein, 105 aa, Homo sapiens
VFCHVSDYSKGFGGKYGVQKDRMDKNASTFEDVTQVSSAYQKTVPVEAVTSKTSNIRANFENLAKEKEQEDRRKAEAERAQRMAKERQEQEEARRKLEVSGKEWA

SEQ ID NO: 760474 - protein, 550 aa, Homo sapiens; identical to SEQ ID NO: 760453

SEQ ID NO: 760475 - protein, 554 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKAREQLRLSLFLALSRAGAQEADENKPVLVRKTVLLKWLRCKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760476 - protein, 481 aa, Homo sapiens
MEEKKAFMGPLKKDRIQRKKELNAFFSSHGLEAGPCVLEFGRCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760477 - protein, 630 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRSALWRVGRKDCPRRGASSRVSLLGRRGLGLMEVNPELSHPEHRSCHVRWEICLCHTVTARRIR

SEQ ID NO: 760478 - protein, 376 aa, Homo sapiens
LGLHSVTAEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760479 - protein, 353 aa, Homo sapiens; identical to SEQ ID NO: 760455

SEQ ID NO: 760480 - protein, 265 aa, Homo sapiens
CDQLERGLQVHHSQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760481 - protein, 252 aa, Homo sapiens
LPQGMEKREKCSPDAHVLSLQNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 760482 - protein, 550 aa, Homo sapiens; identical to SEQ ID NO: 760453

SEQ ID NO: 760483 - protein, 671 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRSALWRVGRKDCPRRGASSRVSLLGRRGLGLMEVNPELSHPEHRSCHVRWEICLCHTVTARRIRKLISFLRSREAGPVPSCSQVGGVSFQKVTWKCLGTWVPECP

SEQ ID NO: 760484 - protein, 409 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAQTTPLEWPKGSL

SEQ ID NO: 760485 - protein, 431 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEETRSISWSGGASGGDEEHLVERRSISWRGGASRGAEEHLARDEEYVWRRRGVVSGRDEEKCLAETQEYCLPYYHVA

SEQ ID NO: 760486 - protein, 241 aa, Homo sapiens; identical to SEQ ID NO: 760472

SEQ ID NO: 760487 - protein, 233 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVIVGL

SEQ ID NO: 760488 - protein, 506 aa, Homo sapiens
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 760489 - protein, 516 aa, Homo sapiens
MPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVVRACSRPGVGKAALLPPFLTRCLCSPKKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 760490 - protein, 194 aa, Homo sapiens
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLVRPALAPPHPGAGNTASQAAYLCRRLGHQARGLSLVVG

SEQ ID NO: 760491 - protein, 131 aa, Homo sapiens
PEAQEGLHREGGGDTEPVEEHCGPVCELADGVRDPPLLCQEHDGPLETFLCSGNKVLLKPAWNFFFFFFFQKGNFFFFLASMNMHFRNLQRTFFTFVFVPQHSQEYKIGALQAAHEDGPGAKPSRAAEQHL

SEQ ID NO: 760492 - protein, 150 aa, Homo sapiens
MYGKIIFVLLLSAIVSISASSTTGVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 760493 - protein, 133 aa, Homo sapiens
SPGAATAYAGLKVARRQMRDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDKWRNGTTCPSFHCTRYVNI

SEQ ID NO: 760494 - protein, 150 aa, Homo sapiens; identical to SEQ ID NO: 760492

SEQ ID NO: 760495 - protein, 91 aa, Homo sapiens
MYGKIIFVLLLSEIVSISALSTTEVAMHTSTSSSVTKSYISSQTNGETGQLVHRFTVPAPVVIILIILCVMAGIIGTILLISYTIRRLIKA

SEQ ID NO: 760496 - protein, 137 aa, Homo sapiens
MYGKIIFVLLLSAIVSISASSTTGVAMHTSTSSSVTKSYISSQTNDTHKRDTYAATPRAHEVSEISVRTVYPPEEETEITLIIFGVMAGVIGTILLISYGIRRLIKKSPSDVKPLPSPDTDVPLSSVEIENPETSDQ

SEQ ID NO: 760497 - protein, 115 aa, Homo sapiens
MYGKIIFVLLLSAIVSISASSTTGVAMHTSTSSSVTKSYISSQTNDTHKRDTYAATPRAHEVSEISVRTVYPPEEETGERVQLAHHFSEPEITLIIFGVMLVVVGMIILISYCIR

SEQ ID NO: 760498 - protein, 124 aa, Homo sapiens
MHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 760499 - protein, 117 aa, Homo sapiens
MYGKIIFVLLLSDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 760500 - protein, 150 aa, Homo sapiens; identical to SEQ ID NO: 760492

SEQ ID NO: 760501 - protein, 150 aa, Homo sapiens; identical to SEQ ID NO: 760492

SEQ ID NO: 760502 - protein, 115 aa, Homo sapiens; identical to SEQ ID NO: 760497

SEQ ID NO: 760503 - protein, 108 aa, Homo sapiens
MYGKIIFVLLLSEIVSISALSTTEVAMHTSTSSSVTKSYISSQTNAPVVIILIILCVMAGIIGTILLISYSIRRLIKKSPSDVKPLPSPDTDVPLSSVEIENPETSDQ

SEQ ID NO: 760504 - protein, 78 aa, Homo sapiens
MYGKIIFVLLLSEIVSISASSTTGVAMHTSTSSSVTKSYISSQTNGITLINWWAMARVIFEVMLVVVGMIILISYCIR

SEQ ID NO: 760505 - protein, 142 aa, Homo sapiens
GLDPPPTVSPQPPALLALVTRAGSPERNQKDRKGIPGLPFHIRQERDPPPARSACPGAPRCLQLQEDVWEQTQKLSLPDKQDKETQTKSWPVWSRSGLRDDKKICSVQMAHLVPTKPWGPRKIRHPLLTSPSSRAPSSRAHL

SEQ ID NO: 760506 - protein, 126 aa, Homo sapiens
LIYSTRIKFVGSARIELLSVSSVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 760507 - protein, 324 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 760508 - protein, 324 aa, Homo sapiens; identical to SEQ ID NO: 760507

SEQ ID NO: 760509 - protein, 324 aa, Homo sapiens; identical to SEQ ID NO: 760507

SEQ ID NO: 760510 - protein, 300 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCCSNS

SEQ ID NO: 760511 - protein, 324 aa, Homo sapiens; identical to SEQ ID NO: 760507

SEQ ID NO: 760512 - protein, 198 aa, Homo sapiens
MEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 760513 - protein, 324 aa, Homo sapiens; identical to SEQ ID NO: 760507

SEQ ID NO: 760514 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 760515 - protein, 161 aa, Homo sapiens; identical to SEQ ID NO: 760514

SEQ ID NO: 760516 - protein, 161 aa, Homo sapiens; identical to SEQ ID NO: 760514

SEQ ID NO: 760517 - protein, 161 aa, Homo sapiens; identical to SEQ ID NO: 760514

SEQ ID NO: 760518 - protein, 161 aa, Homo sapiens; identical to SEQ ID NO: 760514

SEQ ID NO: 760519 - protein, 161 aa, Homo sapiens; identical to SEQ ID NO: 760514

SEQ ID NO: 760520 - protein, 181 aa, Homo sapiens
CCVGTPEYGICDLAAAARLEEAAAAEDPSPDPGLRSQNHEPGHQHRSPANSQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 760521 - protein, 142 aa, Homo sapiens
MRVHHPSLPKEAKSMALLPLPASTHSGEGYKGGQDPLRLSQAPKSFQSSDPQPPSQVGWSPRAAQGLAQVSKGGTSSPRPSVPAPAGWCLSPSDSPLPRRPAFSGTSAGPEASHGVRPRSRTLLRKWLFPTPSPHPVVLPVL

SEQ ID NO: 760522 - protein, 157 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRFLFFFFFFSSNTSWLLLLLLSLSLLQATDFMSL

SEQ ID NO: 760523 - protein, 161 aa, Homo sapiens; identical to SEQ ID NO: 760514

SEQ ID NO: 760524 - protein, 142 aa, Homo sapiens; identical to SEQ ID NO: 760521

SEQ ID NO: 760525 - protein, 161 aa, Homo sapiens; identical to SEQ ID NO: 760514

SEQ ID NO: 760526 - protein, 74 aa, Homo sapiens
VDLDDFPLSPTPGTYTCALHHSGHSPPISSQNVTVLRDKLVKCEGISLLAQNTSWLLLLLLSLSLLQATDFMSL

SEQ ID NO: 760527 - protein, 161 aa, Homo sapiens; identical to SEQ ID NO: 760514

SEQ ID NO: 760528 - protein, 161 aa, Homo sapiens; identical to SEQ ID NO: 760514

SEQ ID NO: 760529 - protein, 161 aa, Homo sapiens; identical to SEQ ID NO: 760514

SEQ ID NO: 760530 - protein, 156 aa, Homo sapiens
SLDVRTTLLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 760531 - protein, 151 aa, Homo sapiens
RTNFTSKYNMKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 760532 - protein, 185 aa, Homo sapiens
ATAAQDQTLAGSQNADCRGRAWLRRSHPSGRGVTSFMEDVGRNFYYLCLVLPSKSIKYLKINGKEEKKEQRPASYPSQDPSVLLLLKLEWGDPGGSRRCTKRAANSKYNMKVLYLSAFTSKDEGTYTCALHHSGHSPPISSQNVTVLRDKLVKCEGISLLAQNTSWLLLLLLSLSLLQATDFMSL

SEQ ID NO: 760533 - protein, 142 aa, Homo sapiens; identical to SEQ ID NO: 760521

SEQ ID NO: 760534 - protein, 142 aa, Homo sapiens; identical to SEQ ID NO: 760521

SEQ ID NO: 760535 - protein, 161 aa, Homo sapiens; identical to SEQ ID NO: 760514

SEQ ID NO: 760536 - protein, 161 aa, Homo sapiens; identical to SEQ ID NO: 760514

SEQ ID NO: 760537 - protein, 263 aa, Homo sapiens
MRLARRSRCLISVPGLALLLIARHSGLTEFSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIRCQWKME

SEQ ID NO: 760538 - protein, 991 aa, Homo sapiens
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 760539 - protein, 755 aa, Homo sapiens
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKKKQKKKKQTKNKQKKKQKKKKHTGRPSHSGGSKNKSEKSGRGRQRSHQSNSLENKGENGRAPQKGAKIYKTREPVIE

SEQ ID NO: 760540 - protein, 115 aa, Homo sapiens
LTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGS

SEQ ID NO: 760541 - protein, 991 aa, Homo sapiens; identical to SEQ ID NO: 760538

SEQ ID NO: 760542 - protein, 1002 aa, Homo sapiens
MRLARRSRCLISVPGLALLLIARHSGLTEFSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 760543 - protein, 164 aa, Homo sapiens
ILRYIRTRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 760544 - protein, 305 aa, Homo sapiens
MDGPMRPRSASLVDFQFGVVATETIEDALLHLAQQNEQAVREASGRLGRFREPQIVGFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 760545 - protein, 275 aa, Homo sapiens
MDGPMRPRSASLVDFQFGVVATETIEDALLHLAQQNEQAVREASGRLGRFREPQIVGFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVCTTEQDQHGCGAFAEHHWYCLGKHC

SEQ ID NO: 760546 - protein, 330 aa, Homo sapiens
MDGPMRPRSASLVDFQFGVVATETIEDALLHLAQQNEQAVREASGRLGRFREPQIVEFVFLLSEQWCLEKSVSYQAVEILERFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 760547 - protein, 137 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 760548 - protein, 137 aa, Homo sapiens; identical to SEQ ID NO: 760547

SEQ ID NO: 760549 - protein, 137 aa, Homo sapiens; identical to SEQ ID NO: 760547

SEQ ID NO: 760550 - protein, 137 aa, Homo sapiens; identical to SEQ ID NO: 760547

SEQ ID NO: 760551 - protein, 137 aa, Homo sapiens; identical to SEQ ID NO: 760547

SEQ ID NO: 760552 - protein, 137 aa, Homo sapiens; identical to SEQ ID NO: 760547

SEQ ID NO: 760553 - protein, 137 aa, Homo sapiens; identical to SEQ ID NO: 760547

SEQ ID NO: 760554 - protein, 240 aa, Homo sapiens
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 760555 - protein, 118 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGECPCQL

SEQ ID NO: 760556 - protein, 137 aa, Homo sapiens; identical to SEQ ID NO: 760547

SEQ ID NO: 760557 - protein, 200 aa, Homo sapiens
MGFGATLAVGLTIFVLSVVTIIICFTCSCCCLYKTCRRPRPSASKCAAQLPWTKLPGLPHHAASARDASSTLPNAVPTTLPSPAHGPTGLPRDPGWRSSRALPRQPASLQPGLHGCPEGGPLSIPWPLWLPLGYVVCVREWCAGAVPYAPCVLCVSRHGSLRPMCAVCVLPVYVASSDADKVGNNPCQSGLGPDFVLFLT

SEQ ID NO: 760558 - protein, 116 aa, Homo sapiens
LRTLTWGRCSQGETSAPPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 760559 - protein, 227 aa, Homo sapiens
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPLTTRPTWMPRRRPSEHSLASLAATWLCCVCA

SEQ ID NO: 760560 - protein, 124 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPLTTRPTWMPRRRPSEHSLASLAATWLCCVCA

SEQ ID NO: 760561 - protein, 160 aa, Homo sapiens
MPLILSLQVCRPATLDQATRATTPCRLSQGCQQHPTQCSTHHLTQPSPWAHRPTTRPWLVSAPANSSPARLPESLPASLGHPSQTTSLNRPLPLSACLPLTRQPTMLTANQGPLCFQEEQPRPTPPASLLTTRPTWMPRRRPSEHSLASLAATWLCCVCA

SEQ ID NO: 760562 - protein, 140 aa, Homo sapiens
MARPRSWGYPLQSQGHDAGEAWDLAKLDFDPLGRCPIAPWSLSCLLGIRQPPDARTPQAEPYSAVPVCLDCPLSPHLPWDQLEGHMHTQPSCPQGALLPLLALPFPQVSRAPVHQHTQFSSLQCFHFILAKHFACFLFQT

SEQ ID NO: 760563 - protein, 140 aa, Homo sapiens; identical to SEQ ID NO: 760562

SEQ ID NO: 760564 - protein, 118 aa, Homo sapiens; identical to SEQ ID NO: 760555

SEQ ID NO: 760565 - protein, 137 aa, Homo sapiens; identical to SEQ ID NO: 760547

SEQ ID NO: 760566 - protein, 240 aa, Homo sapiens; identical to SEQ ID NO: 760554

SEQ ID NO: 760567 - protein, 112 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAV

SEQ ID NO: 760568 - protein, 112 aa, Homo sapiens; identical to SEQ ID NO: 760567

SEQ ID NO: 760569 - protein, 94 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAASNTGDNLE

SEQ ID NO: 760570 - protein, 140 aa, Homo sapiens; identical to SEQ ID NO: 760562

SEQ ID NO: 760571 - protein, 124 aa, Homo sapiens
PLSPQTGTAELDFDPLGRCPIAPWSLSCLLGIRQPPDARTPQAEPYSAVPVCLDCPLSPHLPWDQLEGHMHTQPSCPQGALLPLLALPFPQVSRAPVHQHTQFSSLQCFHFILAKHFACFLFQT

SEQ ID NO: 760572 - protein, 137 aa, Homo sapiens; identical to SEQ ID NO: 760547

SEQ ID NO: 760573 - protein, 137 aa, Homo sapiens; identical to SEQ ID NO: 760547

SEQ ID NO: 760574 - protein, 124 aa, Homo sapiens; identical to SEQ ID NO: 760560

SEQ ID NO: 760575 - protein, 172 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPGRWRTFRLSVPTKSSRPSFKTRRGSCWEKLARRSSRGTTRTSVWGFKTPKEAIEGTYIDKKCPFTGNVSIRGRILSGVV

SEQ ID NO: 760576 - protein, 112 aa, Homo sapiens
MDNLATVSPCFPTPASWNMQQLLYPSPRCSGSRDTWANGPSGPKVGCGALDGSSGPDMNTSCSSSLYYCFTRAVLAQICCVSESRVCTLVYNKCNRLEAAAPFLPGLGCWNW

SEQ ID NO: 760577 - protein, 284 aa, Homo sapiens
GLLQAEGPWLVFWGGSVQGDYYGDLAARLGYFPSSIVREDQTLKPGKVDVKTEHFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCGRTILNKIDSGELDPERMGSGIQYGDAFLRKLREPRECPGRGPSAVWLLSSVGARFTWFSRTKPAGAQAKV

SEQ ID NO: 760578 - protein, 236 aa, Homo sapiens
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCGRTILNKIDSGELDPERMGSGIQYGDAFLRKLREPRECPGRGPSAVWLLSSVGARFTWFSRTKPAGAQAKV

SEQ ID NO: 760579 - protein, 1279 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 760580 - protein, 1286 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 760581 - protein, 1232 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 760582 - protein, 1318 aa, Homo sapiens
VGGGGGGGGEAAASKVQAPLLQRPRVQRPCQTRARFEAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 760583 - protein, 1292 aa, Homo sapiens
MRKQAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 760584 - protein, 1293 aa, Homo sapiens
MRKQAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMINLEDPIWGLLRHLKFES

SEQ ID NO: 760585 - protein, 1052 aa, Homo sapiens
MRKQAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNIAFNVSSSKATDI

SEQ ID NO: 760586 - protein, 587 aa, Homo sapiens
MRKQAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKVSRL

SEQ ID NO: 760587 - protein, 1177 aa, Homo sapiens
MRKQAEMDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHVS

SEQ ID NO: 760588 - protein, 284 aa, Homo sapiens
MERLVIRMPFCHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWETSPESGPRALNKSHSTLKVIPWST

SEQ ID NO: 760589 - protein, 210 aa, Homo sapiens
MVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWETSPESGPRALNKSHSTLKVIPWST

SEQ ID NO: 760590 - protein, 309 aa, Homo sapiens
MERLTLTRTIGGPLLTATLLGKTTINDYQVIRMPFCHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWETSPESGPRALNKSHSTLKVIPWST

SEQ ID NO: 760591 - protein, 218 aa, Homo sapiens
MVTFSENHGVVIQPAYKDKINITQLGLQNSTITFWNITLEDEGCYMCLFNTFGFGKISGTACLTVYDHNLFFVPVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWETSPESGPRALNKSHSTLKVIPWST

SEQ ID NO: 760592 - protein, 284 aa, Homo sapiens; identical to SEQ ID NO: 760588

SEQ ID NO: 760593 - protein, 284 aa, Homo sapiens; identical to SEQ ID NO: 760588

SEQ ID NO: 760594 - protein, 284 aa, Homo sapiens; identical to SEQ ID NO: 760588

SEQ ID NO: 760595 - protein, 284 aa, Homo sapiens; identical to SEQ ID NO: 760588

SEQ ID NO: 760596 - protein, 164 aa, Homo sapiens
AQPLGARTDPLLQCRMSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLVCSLWWVESSYL

SEQ ID NO: 760597 - protein, 171 aa, Homo sapiens
GRVGRPTRPDPASAEVEELLLVLGPEEGRAGAGPTGPSERPTRHPPTPQPLGARTDPLLQCRMSQGDSNPAAIPHAAEDIQGDDRWMSQRQDSCTVAHACNPSTLGGRGRRIAGVQEFETSLGNIVRAHLYKNKSKLAGHVWLTPVIPALWKAKVGRLLELRSSRPAWATW

SEQ ID NO: 760598 - protein, 291 aa, Homo sapiens
GRVGRPTRPDPASAEVEELLLVLGPEEGRAGAGPTGPSERPTRHPPTPQPLGARTDPLLQCRMSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 760599 - protein, 291 aa, Homo sapiens; identical to SEQ ID NO: 760598

SEQ ID NO: 760600 - protein, 125 aa, Homo sapiens
GRVGRPTRPDPASAEVEELLLVLGPEEGRAGAGPTGPSERPTRHPPTPQPLGARTDPLLQCRMSQGDSNPAAIPHALLASLLTEDQISLCELALSSFAHVYKPQMLLHFISTRAIQAIVFEPLAF

SEQ ID NO: 760601 - protein, 399 aa, Homo sapiens
GAVALPLALRRRRRALRRLGRCSQWCGVRKGTDLGALPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760602 - protein, 311 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVVWLYVIHVQRWHSWLLVSRLSTLGLYF

SEQ ID NO: 760603 - protein, 282 aa, Homo sapiens
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760604 - protein, 282 aa, Homo sapiens; identical to SEQ ID NO: 760603

SEQ ID NO: 760605 - protein, 331 aa, Homo sapiens
TRGSTHASGGRSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760606 - protein, 368 aa, Homo sapiens
MPKKLLLLPPPSASSAFRVPRARPVPPPAMNAARTGYRVFSANSTAACTELAKRITERLGAELGKSVVYQETNGETKMFRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760607 - protein, 208 aa, Homo sapiens
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVVWLYVIHVQRWHSWLLVSRLSTLGLYF

SEQ ID NO: 760608 - protein, 148 aa, Homo sapiens
MDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760609 - protein, 385 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760610 - protein, 360 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVRLLLNLEPRFTAVFSGNNKMIQSILK

SEQ ID NO: 760611 - protein, 83 aa, Homo sapiens
GAVALPLALRRRRRALRRLGRCSQWCGVRKGTDLGALPACAEFLSAFPTQTGVSQSEALRVQPRAGPVVTAPRAGRCPRSCCC

SEQ ID NO: 760612 - protein, 385 aa, Homo sapiens; identical to SEQ ID NO: 760609

SEQ ID NO: 760613 - protein, 385 aa, Homo sapiens; identical to SEQ ID NO: 760609

SEQ ID NO: 760614 - protein, 212 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKR

SEQ ID NO: 760615 - protein, 367 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 760616 - protein, 385 aa, Homo sapiens; identical to SEQ ID NO: 760609

SEQ ID NO: 760617 - protein, 148 aa, Homo sapiens; identical to SEQ ID NO: 760608

SEQ ID NO: 760618 - protein, 385 aa, Homo sapiens; identical to SEQ ID NO: 760609

SEQ ID NO: 760619 - protein, 311 aa, Homo sapiens; identical to SEQ ID NO: 760602

SEQ ID NO: 760620 - protein, 77 aa, Homo sapiens
MDEGPSTMARATATSCHTAAKPGPPTITYPLPPRCPASTDAKELVPGLSQTHRGPAGLPQAACERQQGDVLVRGGRR

SEQ ID NO: 760621 - protein, 133 aa, Homo sapiens
TQPGSQAPPRQLSRFSHSFPTRLLSPMAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 760622 - protein, 129 aa, Homo sapiens
TQPGSQAPPRQLSRFSHSFPTRLLSPMAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNK

SEQ ID NO: 760623 - protein, 166 aa, Homo sapiens
TQPGSQAPPRQLSRFSHSFPTRLLSPMAHATLSAAPSNPRLLRVALLLLLLVAASRRAAGGSRRPGVPGPDAAGVGAPRRTAPLNQRVYSSLGASVVTELRCQCLQTLQGIHLKNIQSVNVRSPGPHCAQTEVIATLKNGKKACLNPASPMVQKIIEKILNKGSTN

SEQ ID NO: 760624 - protein, 211 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRASEEAFVKESKEETPGTEWEKVAQLCDFNPKSSKQCKDVSRLRSVLMSLKQTPLSR

SEQ ID NO: 760625 - protein, 67 aa, Homo sapiens
CRNSARGSTFGASEEAFVKESKEETPGTEWEKVAQLCDFNPKSSKQCKDVSRLRSVLMSLKQTPLSR

SEQ ID NO: 760626 - protein, 229 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRIADKAFYQQPDADIIGYVASEEAFVKESKEETPGTEWEKVAQLCDFNPKSSKQCKDVSRLRSVLMSLKQTPLSR

SEQ ID NO: 760627 - protein, 211 aa, Homo sapiens; identical to SEQ ID NO: 760624

SEQ ID NO: 760628 - protein, 71 aa, Homo sapiens
VYLCVSNQDQVGKAGASEEAFVKESKEETPGTEWEKVAQLCDFNPKSSKQCKDVSRLRSVLMSLKQTPLSR

SEQ ID NO: 760629 - protein, 134 aa, Homo sapiens
MADDFGFFSSSESGAPEAAEEDPAAAFLAQQESEIAGIENDEGFGAPAGSHAAPAQPGPTSGAGSEDMGTTVNGDVFQPVHHQRVQLQTQLPIQPKDEPAHNYSSSIWHSQGQGQKGPAGLRLPTSAQILSPFP

SEQ ID NO: 760630 - protein, 161 aa, Homo sapiens
GAQSERAVPHEWAGSEDMGTTVNGDVFQEANGPADGYAAIAQADRLTQEPESIRKWREEQRKRLQELDAASKVTEQEWREKAKKDLEEWNQRQSEQVEKNKINNRASEEAFVKESKEETPGTEWEKVAQLCDFNPKSSKQCKDVSRLRSVLMSLKQTPLSR

SEQ ID NO: 760631 - protein, 211 aa, Homo sapiens; identical to SEQ ID NO: 760624

SEQ ID NO: 760632 - protein, 229 aa, Homo sapiens; identical to SEQ ID NO: 760626

SEQ ID NO: 760633 - protein, 134 aa, Homo sapiens; identical to SEQ ID NO: 760629

SEQ ID NO: 760634 - protein, 124 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELGHPRRLS

SEQ ID NO: 760635 - protein, 160 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRCDCPS

SEQ ID NO: 760636 - protein, 134 aa, Homo sapiens; identical to SEQ ID NO: 760629

SEQ ID NO: 760637 - protein, 98 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAANCPAVGLGR

SEQ ID NO: 760638 - protein, 440 aa, Homo sapiens
LINQMNLHMRMTAFCKDHDSRSGKQPSQTLSPSDFLDKLMGRTSGYDARIRPNFKGPPVNVTCNIFINSFGSVTETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 760639 - protein, 452 aa, Homo sapiens [sequence omitted]

SEQ ID NO: 760640 - protein, 217 aa, Homo sapiens
LSEDLMDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCAGELPLLHSPLPLPRG

SEQ ID NO: 760641 - protein, 501 aa, Homo sapiens
MTSSCCVTNNLQASLKSCPRPASVCSSGVNCRPELCLGYVCQPMACLPSVCLPTTFRPASCLSKTYLSSSCQAASGISGSMGPGSWYSEGAFNGNEKETMQFLNDRLASYLTRVRQLEQENAELESRIQEASHSQVLTMTPDYQSHFRTIEELQQKILCTKAENARMVVNIDNAKLAADDFRAKYEAELAMRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKLPCNPCSTPSCTTCVPSPCVHPHRLCATHCWHALLTLPPGPLLKSLCASGSWRAWGWAAWYSVATRRAGPAPVSKEDPEQDRGSPATSSDTPGDT

SEQ ID NO: 760642 - protein, 112 aa, Homo sapiens
DKSSSCPGPMHSSVHAQFSVNVKDPSNCHMSDFRHEILPFHIAWHIQNGEFEFTKLQVLKKYISSSPRTSNSLNISQSSREEDLLQGWLQGCWILPLLLSSLHLGSSCFVSS

SEQ ID NO: 760643 - protein, 249 aa, Homo sapiens
MRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQVGLSRWGWPPRIPKTGTLAFSFPQLQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKYAGPAEA

SEQ ID NO: 760644 - protein, 243 aa, Homo sapiens
MVQYAGGPLTVGMASSISLRLGTLAFSFPQLQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKLPCNPCSTPSCTTCVPSPCVHPHRLCATHCWHALLTLPPGPLLKSLCASGSWRAWGWAAWYSVATRRAGPAPVSKEDPEQDRGSPATSSDTPGDT

SEQ ID NO: 760645 - protein, 337 aa, Homo sapiens
MRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQVGLSRWGWPPRIPKTGTLAFSFPQLQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKLPCNPCSTPSCTTCVPSPCVHPHRLCATHCWHALLTLPPGPLLKSLCASGSWRAWGWAAWYSVATRRAGPAPVSKEDPEQDRGSPATSSDTPGDT

SEQ ID NO: 760646 - protein, 337 aa, Homo sapiens
MRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQVGLSRWGWPPDIPKTGTLAFSFPQLQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLESEDCKLPCNPCSTPSCTTCVPSPCVHPHRLCATHCWHALLTLPPGPLLKSLCASGSWRAWGWAAWYSVATRRAGPAPVSKEDPEQDRGSPATSSDTPGDT

SEQ ID NO: 760647 - protein, 97 aa, Homo sapiens
DPDQKIEIETDEENEVPNPRWTLTAGQAPQCCSCVSEAENRYRASSDSGPGGGKRRGRRRNESPVCSWGLVRGPENSLQAFARALIKAAKRRTGLRA

SEQ ID NO: 760648 - protein, 116 aa, Homo sapiens
RPFQTPPSPGTSRRAHHGKRQAKRRPRIPNVTRPLELARRGRVEDENRRPIPLTLTAGKLPSVVVVFRRPRTAIGLPRTLALEGGNGEGEGETSLQCVLGAWCEAQRILCRPLPGH

SEQ ID NO: 760649 - protein, 155 aa, Homo sapiens
MGPCPLLQEPDGQASCPFLPPPSSWNSHPHCCLLWTPAPELKRAGALGPTKMWEKQSLELGAWNLDPPVPALPLPRHPGACHYWRGLQMTSQGPTSVLCEHKQRCRVPRAQRTRRGQDPACLVPCRLFPCCGHCCHLLHCLKASPHALCHSHSAL

SEQ ID NO: 760650 - protein, 61 aa, Homo sapiens
FSLEEWQCLDTAQQNLYRNVMLENYRNLVFLGIAVSNLDLITCLEQGKEPWNMKRHEMVAK

SEQ ID NO: 760651 - protein, 315 aa, Homo sapiens
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEDDLLIEVSEKYRLHLNLPKLIDTEMTTAKFIKEKSTLIITMPLV

SEQ ID NO: 760652 - protein, 273 aa, Homo sapiens
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEVS

SEQ ID NO: 760653 - protein, 137 aa, Homo sapiens
METSSKGLLTQVTQFWNLLDDLAQSDPEGYEKFIQQQLKEGKQLCAAPEPQLCLQTRILTESYFVTRLECNGVVLARCNLCLPGLSDSPASASQVAGITETKRKNTFYQPVSVDKDPSSPINHSSSTSNCWQTRRYN

SEQ ID NO: 760654 - protein, 315 aa, Homo sapiens; identical to SEQ ID NO: 760651

SEQ ID NO: 760655 - protein, 137 aa, Homo sapiens; identical to SEQ ID NO: 760653

SEQ ID NO: 760656 - protein, 255 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKNR

SEQ ID NO: 760657 - protein, 183 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMHDVYGMVLNEKNNGLQAVCFR

SEQ ID NO: 760658 - protein, 137 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRA

SEQ ID NO: 760659 - protein, 240 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMITSFTSRITQDREQLMFPFHFVDRLGKHDVTCTVSGGGRSAQAGAIRLAMAKALCSFVTEDEVRVDEDKLDYLLLIHV

SEQ ID NO: 760660 - protein, 913 aa, Homo sapiens
MSEELAPQAQPAFPWAAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLICNVTLGGENRETRENVTIYSFPAPLLTLSEPSVSEGQMVTVTCAAGTQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 760661 - protein, 924 aa, Homo sapiens [sequence omitted]

SEQ ID NO: 760662 - protein, 129 aa, Homo sapiens
LHYSPSLPGPAPWVPGSSPSGPTFCSKSRCSKSCGLFPLAERPDRVELMPLPPWQPVGENFTLSCRVPGAGPRASLTLTLLRGAQELIRRSFAGEPPRARGAVLTATVLARREDHGANFSCRAELDLRP

SEQ ID NO: 760663 - protein, 210 aa, Homo sapiens
RSLLCCFCQHSSFPAIYTSCPFVPIILDANHPLSTTMGKITFYEDRDFQGRCYNCISDCPNLRVYFSRCNSIRVDSGCWMLYERPNYQGHQYFLRRGKYPDYQHWMGLSDSVQSCRIIPHTSSHKLRLYERDDYRGLMSELTDDCACVPELFRLPEIYSLHVLEGCWVLYEMPNYRGRQYLLRPGDYRRYHDWGGADAKVGSLRRVTDLY

SEQ ID NO: 760664 - protein, 142 aa, Homo sapiens
SAQGVGGGLPPGNVTLAGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMPWPSAWASCSSSLLSSTA

SEQ ID NO: 760665 - protein, 98 aa, Homo sapiens
LPLNSRAVVNCSVHGLPTPALRWTKDSTPLGDGPMLSLSSITFDSNGTYVCEASLPTVPVLSRTQNFTLLVQGSGGREGVGLDGDSVGCGTWTNRTSS

SEQ ID NO: 760666 - protein, 116 aa, Homo sapiens
WTSGKWVDSDRGSLTEGVKNGSKVSDLGEIMELLPVPLITPFSESCLLTHREGPLSCSYWVPIVFAAWPSLPFWEWTLPSWEASIAPSSLHGCCGGHCVNAQPLSRDAGPKMGQSE

SEQ ID NO: 760667 - protein, 470 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760668 - protein, 470 aa, Homo sapiens; identical to SEQ ID NO: 760667

SEQ ID NO: 760669 - protein, 471 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSCVSVLDIMVLNATRSSAFSGSGALGGSTQPRLTLFSIYPQRFKEKKPFKTSYTHLDLFVAVSHLSWLEKKTATALLESPLSATVEDALQSFLKV

SEQ ID NO: 760670 - protein, 375 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRPLMRSSSKRHPMVSRKTSWMGPNGTLRDGACFPDATWKRTREWLGGEGFRLSGRGVTPLAPALSTSRPPREPRSQMLRVKGGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760671 - protein, 178 aa, Homo sapiens
MVRWDTVGQKRVPRGERGTRNRGRWASSHPIKTARGGHPRVLETHPRRGSAAHTGALTPGGPAEPNIKYARPWKTTHRKEKRETARERGQNRQAEQGGHRITPSTKERSHTRQHDNREDRTDQTATHNKKKTKPKDRKQQSDTTNNTTRTLEPQSTETETTAHSANAKKSHRNKKRQT

SEQ ID NO: 760672 - protein, 493 aa, Homo sapiens
DVTVTDSVSPRRLLPWWLAAGCSMSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760673 - protein, 504 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRPLMRSSSKRHPMVSRKTSWMGPNGTLRDGACFSRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760674 - protein, 264 aa, Homo sapiens
MGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760675 - protein, 327 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWSLT

SEQ ID NO: 760676 - protein, 169 aa, Homo sapiens
MAHFLLGRWCYQVSCVSVLDIMVLNATRSSAFSGSGALGGSTQPRLTLFSIYPQRFKEKKPFKTSYTHLDLFVAVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 760677 - protein, 175 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGG

SEQ ID NO: 760678 - protein, 200 aa, Homo sapiens
KIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 760679 - protein, 120 aa, Homo sapiens
KIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKY

SEQ ID NO: 760680 - protein, 128 aa, Homo sapiens
KIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKVSPSEKSNG

SEQ ID NO: 760681 - protein, 120 aa, Homo sapiens; identical to SEQ ID NO: 760679

SEQ ID NO: 760682 - protein, 122 aa, Homo sapiens
TLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 760683 - protein, 119 aa, Homo sapiens
RQSLTLSPRLEYSGTISVHCNLCLSDSSDSPASTSQVAGITGMCYHTRLIFVFLVETGFCQVGQSGLELVTSGDPPISASQSAGITGLSHGAGPLHDLLCLHQAYRYHHNKVKTGSSCY

SEQ ID NO: 760684 - protein, 865 aa, Homo sapiens [sequence omitted]

SEQ ID NO: 760685 - protein, 423 aa, Homo sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 760686 - protein, 145 aa, Homo sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTGCPCSSLARG

SEQ ID NO: 760687 - protein, 68 aa, Homo sapiens
MVPGTPSPLLGRGKELWLESLACLPGAVKRDCTITGWSEPFPPYPVACPVPLELLAEEGCPCSSLARG

SEQ ID NO: 760688 - protein, 359 aa, Homo sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 760689 - protein, 151 aa, Homo sapiens
MLPFSTATTLTTAASPLAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGLHCCHPLLLPQPRGED

SEQ ID NO: 760690 - protein, 178 aa, Homo sapiens
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 760691 - protein, 101 aa, Homo sapiens
LSLIAGRWQQALPAPVQPARSTAAMVSVPTTWCSVALALLVALHEGKGQAAATLEQPASSSHAQGTHLRLRRCSCSSWLDKECVYFCHLDIIWVNTPEFRC

SEQ ID NO: 760692 - protein, 101 aa, Homo sapiens; identical to SEQ ID NO: 760691

SEQ ID NO: 760693 - protein, 137 aa, Homo sapiens
MVSVPTTWCSVALALLVALHEGKGQAAATLEQPASSSHAQGTHLRLRRCSCSSWLDKECVYFCHLDIIWVNTPETEAGAVPSRKSPADVFQTGKTGATTGELLQRLRDISTVKSLFAKRQQEAMREPRSTHSRWRKR

SEQ ID NO: 760694 - protein, 104 aa, Homo sapiens
MVSVPTTWCSVALALLVALHEGKGQAAATLEQPASSSHAQGTHLRLRRCSCSSWLDKECVYFCHLDIIWVNTPEDISTVKSLFAKRQQEAMREPRSTHSRWRKR

SEQ ID NO: 760695 - protein, 148 aa, Homo sapiens
MVSVPTTWCSVALALLVALHEAPGYDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 760696 - protein, 160 aa, Homo sapiens
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRPGSGLFRGFEGS

SEQ ID NO: 760697 - protein, 145 aa, Homo sapiens
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWDISTVKSLFAKRQQEAMREPRSTHSRWRKR

SEQ ID NO: 760698 - protein, 101 aa, Homo sapiens; identical to SEQ ID NO: 760691

SEQ ID NO: 760699 - protein, 233 aa, Homo sapiens
MATPPFRLIRKMFSFKVSRWMGLACFRSLAASSPSIRQKKLMHKLQEEKAFREEMKIFREKIEDFREEMWTFRGKIHAFRGQILGFWEEERPFWEEEKTFWKEEKSFWEMEKSFREEEKTFWKKYRTFWKEDKAFWKEDNALWERDRNLLQEDKALWEEEKALWVEERALLEGEKALWEDKTSLWEEENALWEEERAFWMENNGHIAGEQMLEDGPHNANRGQRLLAFSRGRA

SEQ ID NO: 760700 - protein, 173 aa, Homo sapiens
APPPPAPPPPATAAAAAAPAAPRRPRCSAKGSKMAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 760701 - protein, 140 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 760702 - protein, 173 aa, Homo sapiens; identical to SEQ ID NO: 760700

SEQ ID NO: 760703 - protein, 119 aa, Homo sapiens
MAAARRPPLSATATPNTSGQPRPGASFRALRGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 760704 - protein, 83 aa, Homo sapiens
LIEPSSQLVPAAAPAAPRRPRCSAKGSKMAGWQSYVDNLMCDGCCQEAAIVGYCDAKYVWAATAGGVFQSITPIEIDMIVNAQ

SEQ ID NO: 760705 - protein, 173 aa, Homo sapiens; identical to SEQ ID NO: 760700

SEQ ID NO: 760706 - protein, 173 aa, Homo sapiens; identical to SEQ ID NO: 760700

SEQ ID NO: 760707 - protein, 188 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRYPNITIWSVSSLFFIGPIFICSLSFYMKLHYCGLGCLVMNFFHMYSVPYYC

SEQ ID NO: 760708 - protein, 173 aa, Homo sapiens
APPPPAPPPPATAAAAAAPAAPRRPRCSAKGSKMAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 760709 - protein, 129 aa, Homo sapiens [sequence omitted]

SEQ ID NO: 760710 - protein, 119 aa, Homo sapiens
MAAARRPPLSATATPNTSGQPRPGASFRALRGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 760711 - protein, 173 aa, Homo sapiens; identical to SEQ ID NO: 760708

SEQ ID NO: 760712 - protein, 591 aa, Homo sapiens
VAAAAAAVRRAWTGSPKLGWAAGEEEPQELQLCQLGPSLETPAWLVHASRRPWLSMELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 760713 - protein, 609 aa, Homo sapiens
VAAAAAAVRRAWTGSPKLGWAAGEEEPQELQLCQLGPSLETPAWLVHASRRPWLSMELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDECLPVLWREPSQARCPFLSSGSSLPPPCPRKGQSPGDCPPSFL

SEQ ID NO: 760714 - protein, 549 aa, Homo sapiens
RKAGAKEEVVPSWGPWGSWGQDFDTLKQETLIPMANPVPVQRSHLQGPILRLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 760715 - protein, 591 aa, Homo sapiens; identical to SEQ ID NO: 760712

SEQ ID NO: 760716 - protein, 389 aa, Homo sapiens [sequence omitted]

SEQ ID NO: 760717 - protein, 103 aa, Homo sapiens
RFLCLSSVVVLLSHVFLSPALFLFWFFVLPSAVVALSCSLSRLFVAFLLLLCLVRSSYSSLWSGAFCLVFPALGRALSSLPLFSCLVSSLFFSSPFLLFVFLF

SEQ ID NO: 760718 - protein, 127 aa, Homo sapiens
DRVLRPTLGKKGWGRIALPKTCAPIQASVCFQPPALGGPWGLWVCGGRPLSMSLVLVWQVWFQNRRAKEKRLKKDAGRHRWGQFYKSVKRSRGSSKQEKESSAEDCGVSDSELSFRGEQGWRGQPRP

SEQ ID NO: 760719 - protein, 293 aa, Homo sapiens
MQVSNGFSQELALFGQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTLESREKTSGATQTTVGDALFTTHKPLNPPIKKSE

SEQ ID NO: 760720 - protein, 235 aa, Homo sapiens
MQVSNGFSQELALFGQHKIEDAAITYGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTLESREKTSGATQTTVGDALFTTHKPLNPPIKKSE

SEQ ID NO: 760721 - protein, 287 aa, Homo sapiens [sequence omitted]

SEQ ID NO: 760722 - protein, 334 aa, Homo sapiens
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 760723 - protein, 239 aa, Homo sapiens
MVYSVAAYLNCRYLNGCYLNGCYLNGCYLNGCFEDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 760724 - protein, 106 aa, Homo sapiens
MTDLDLLINFTFPIQMGKQPAKMLSSFLRIKYYWSQHWWSILYRNDFSCRSVTFLTYLPSTKVGQPKPHGVLLSEASTTLLLRVDMWSGKPGLTHISYISYWDGEN

SEQ ID NO: 760725 - protein, 769 aa, Homo sapiens
MRQTPITQIGSFALTHHPHTTGQATAELSTITSCTITACPTNVVNLTTLRSSKTSTTKPCPPMSTNLTTTARHGITAEPMAPQALVWLPLKAPSPPTVPTVRTTMMSSNVMAGGIMMGPNTVGSISRVTPITIGGLTMADPNISVRIYPTIPLACPTTVRLPTMVGPTSPMDPIPTVSPSTTARLPTLAGSNTMSPSITKSPTVAGPTITKSTTMAGPVIMKPTSMESLLITERPFPLIPLWGPTSVGYLTITASTTKVITTPVSTTMATIPTTHSTTTTRPTGTETTISTKTTTARIIPVTSMATTSRALPNSLSHTASRSLIHDAPGPAASRTGVFPYHVAHPRGSAHSMTRSSSTIRSRVTQMSKKVHTQDISTKHSEDWGKEEGQFQKRKTGRLQRTRKKGHSTNLFQWLWEKLTFLIQGFREMIRNLTQSLAFETFIFFVVCLNTVMLVAQTFAEVEIRGEWYFMALDSIFFCIYVVEALLKIIALGLSYFFDFWNNLDFFIMAMAVLDFLLMQTHSFAIYHQSLFRILKVFKSLRALRAIRVLRRLSFLTSVQEVTGTLGQSLPSIAAILILMFTCLFLFSAVLRALFRKSDPKRFQNIFTTIFTLFTLLTLDDWSLIYMDSRAQGAWYIIPILIIYIIIQYFIFLNLVITVLVDSFQTALFKGLEKAKQERAARIQEKLLEDSLTELRAAEPKEVASEGTMLKRLIEKKFGTMTEKQQELLFHYLQLVASVEQEQQKFRSQAAVIDEIVDTTFEAGEEDFRN

SEQ ID NO: 760726 - protein, 90 aa, Homo sapiens
GFRHEELLLVGGLLAGDGDCPGVVTMFLSAVFFAKSKSKNILVRMVSEAGTGFCFNTKRNRLREKLTLLHYDPVVKQRVLFVEKKKIRSL

SEQ ID NO: 760727 - protein, 69 aa, Homo sapiens
RVLGGREQQGPVMMRGRMCEQDGKLQLRTFPGLQDHSVRPCPAAPPCRTCGCLRRGLRCLDSIAVLTDR

SEQ ID NO: 760728 - protein, 79 aa, Homo sapiens
AAAYYYYIRGRVDLAGDGDCPGVVTMFLSAVFFAKSKSNETKSPLRGKEKNTLPLNGGLKMTLIYKEKTEGGDTDSEIL

SEQ ID NO: 760729 - protein, 90 aa, Homo sapiens; identical to SEQ ID NO: 760726

SEQ ID NO: 760730 - protein, 73 aa, Homo sapiens
MAHLDFFLTYKWRAPKSKSLDQLSPNFLLRGRSETKSPLRGKEKNTLPLNGGLKMTLIYKEKTEGGDTDSEIL

SEQ ID NO: 760731 - protein, 90 aa, Homo sapiens; identical to SEQ ID NO: 760726

SEQ ID NO: 760732 - protein, 90 aa, Homo sapiens; identical to SEQ ID NO: 760726

SEQ ID NO: 760733 - protein, 79 aa, Homo sapiens
GFRHEELLLVGGLLAGDGDCPGVVTMFLSAVFFAKSKSNETKSPLRGKEKNTLPLNGGLKMTLIYKEKTEGGDTDSEIL

SEQ ID NO: 760734 - protein, 79 aa, Homo sapiens; identical to SEQ ID NO: 760733

SEQ ID NO: 760735 - protein, 79 aa, Homo sapiens; identical to SEQ ID NO: 760733

SEQ ID NO: 760736 - protein, 105 aa, Homo sapiens
MMSITLTPINPIFFCSKNIWPSYPAVLCVAHTPRQAHPCILLGGKCQAGATWPCLGHTPASGCGGWSAQPQHMDCYVKDDVPQENQDGFTREARAADAHDRGCIL

SEQ ID NO: 760737 - protein, 574 aa, Homo sapiens
VIVRVRKVGVPSRGSAEKPRPPRPPETQSAPERPRVAGQHQGQRPGLHWGPAPGLPSVAGRGTAAPCAAGSRFSPPHPSLRNSDCSRLPCGSLFFRKASVLSLHFKSRGLAQSPPLKSFPPSSGSCGKPRVLDCSSGCQRWQSQSVRCSSPAHSPLSLPLALPPFLSSSLSSSTAPSLSCLLSFLHRESNCAKPWLPRTNPERDPGTGTATPPKLDEAAGPVCARAWRRSAWEGTSGALETPGPSSFSMEPAQSGPFSQDSPQVLCGCWERSLLCKVDVRWIYVSEGTKTQRRHRQGSLRRGRMQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 760738 - protein, 272 aa, Homo sapiens
GSSRKSINKWDIHALHRNLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 760739 - protein, 117 aa, Homo sapiens
EGSAVSQSVQRSSGHRFDASEGTAIIIPGNIDCWLVELIAKFEECASDTKAGPFVKWGLEAAHCQKEPGLHPFPLRHSLAFGASSLGLLVKCVPVLGFSFWISVPLRLSGPYCDLHT

SEQ ID NO: 760740 - protein, 118 aa, Homo sapiens
MRSFTTSRSSGPGAARARLCASRRCAPTGRHLSQKVQPIALSRRSSSMASTSCSPGRPLASLEPVWQPAINYIDSKFEDYLNAESRVNRCQMPGNRVQCCLYFIAPSGHGLPPSGRIG

SEQ ID NO: 760741 - protein, 117 aa, Homo sapiens
MRSFTTSRSSGPGAARARLCASRRCAPTGRHLSQKVQPIALSRRSSSMASTSCSPGRPLASLEPVWQPAINYIDSKFEDYLNAESRVNRCQMPGNRVQCCLYFIAPSGHGARPKGSM

SEQ ID NO: 760742 - protein, 108 aa, Homo sapiens
QSKVLIKEGGVQLLLTIVDTPGFGDAVDNSNCWQPAINYIDSKFEDYLNAESRVNRCQMPGNRVQCCLYFIAPSGHGSVHGKGLGAATPQQQRAHLLPRTWFLKTILL

SEQ ID NO: 760743 - protein, 141 aa, Homo sapiens
MRSFTTSRSSGPGAARARLCASRRCAPTGRHLSQKVQPIALSRRSSSMASTSCSPGRPLASLEPVWQPAINYIDSKFEDYLNAESRVNRCQMPGNRVQCCLYFIAPSGHGSVHGKGLGAATPQQQRAHLLPRTWFLKTILL

SEQ ID NO: 760744 - protein, 977 aa, Homo sapiens
LADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQAERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 760745 - protein, 977 aa, Homo sapiens; identical to SEQ ID NO: 760744

SEQ ID NO: 760746 - protein, 977 aa, Homo sapiens; identical to SEQ ID NO: 760744

SEQ ID NO: 760747 - protein, 114 aa, Homo sapiens
CDLTGNTGMDGDLLTEAGTGVSNREEWAGEVTNSLVKSRLLCSYNKDFLSAQACLLLLQLRYDDEVKRVVAEPVELAQEFRKFDLNSPWEAFPVYRQPPESLKLEAGDKKPDAK

SEQ ID NO: 760748 - protein, 165 aa, Homo sapiens
PQLGGTAPNSITRLNPLKSHSYTHPYYSHQEYQSPELTISLIENNRNQIIQALLITILLGLYFTLLQASEYFESPFTISDGIYGSTFFVPQASTDFSHYWLNFPLSGYVELRYDDEVKRVVAEPVELAQEFRKFDLNSPWEAFPVYRQPPESLKLEAGDKKPDAK

SEQ ID NO: 760749 - protein, 264 aa, Homo sapiens
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760750 - protein, 264 aa, Homo sapiens; identical to SEQ ID NO: 760749

SEQ ID NO: 760751 - protein, 277 aa, Homo sapiens
MYEAGVLSLHLSNMAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760752 - protein, 264 aa, Homo sapiens; identical to SEQ ID NO: 760749

SEQ ID NO: 760753 - protein, 264 aa, Homo sapiens; identical to SEQ ID NO: 760749

SEQ ID NO: 760754 - protein, 264 aa, Homo sapiens; identical to SEQ ID NO: 760749

SEQ ID NO: 760755 - protein, 264 aa, Homo sapiens; identical to SEQ ID NO: 760749

SEQ ID NO: 760756 - protein, 295 aa, Homo sapiens
GQAVVARDVLRRESSGFPASTVLGRNPALVPHPGRPPIASPPSPLHRTLGADQGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760757 - protein, 335 aa, Homo sapiens
MAAAAVARLWWRGILGASALTRGTGRPSVLLLPVRRESAGADTRPTVRPRNDVAHKQLSAFGEYVAEILPKYVQQVQVILTNVIWVWVKKEAMFAGHVGVGRLVSKKLQIPPSQAWTFLSALNQVTPAEVSCSLSSSLFPLPSLSCVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760758 - protein, 203 aa, Homo sapiens
CGRSNIRMDTDLYLIEAGHLNLLEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760759 - protein, 187 aa, Homo sapiens
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEGVYRCHHSSGGETLTVRSILTNSISLGPQDMAFGKTVFLELLDKLVGSMFSSSVTAEGKV

SEQ ID NO: 760760 - protein, 103 aa, Homo sapiens
MGKYGPGVKSARRALGLRVLLSFRPLPSLHLSNMAAAAVARLWWRGILGASALTRGEHGQPAETGVRRSGVPSAESSSGLIPRVCAFYLPVQGLGDPPFCCCR

SEQ ID NO: 760761 - protein, 301 aa, Homo sapiens
MAAAAVARLWWRGILGASALTRGEHGQPAETGVRRSGVPSAESSSGLIPRVCAFYLPCAGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 760762 - protein, 130 aa, Homo sapiens
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEGSV

SEQ ID NO: 760763 - protein, 110 aa, Homo sapiens
MGKYGPGVKSARRALGLRVLLSFRPLPSLHLSNMAAAAVARLWWRGILGASALTRGTGRPSVLLLPVRRESAGADTRPTVRPRNDVAHKQLSAFGEYVAEILPKCPASMS

SEQ ID NO: 760764 - protein, 223 aa, Homo sapiens
MRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 760765 - protein, 182 aa, Homo sapiens
MRGPGQADCAVAIGRPLGEVVTLRVLESSLNCSAGDMLLLWGRLTWRKMCRKLLDMTFSSKTNTLVVRQRCGRPGGGVLLRYGSQLAPETFYRGMARPSPPPLGAPVLAGRLGGCCWGWGQSQWGSGKIRRELTEMEGTGVGQCQSARAREGSQDECYIPPFWDRAARWTDVGHGPHPQSVP

SEQ ID NO: 760766 - protein, 1362 aa, Homo sapiens
METGLGEVAVPRFSVSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLRPVPPSPLPLLATHLCAGRSLSLGPSQEPAPGGGRGPRTPVPTHKRPRFQTLPSSCPLLRPASSRCTPRDWPGLSRALSQRRTGALRVGPAAASTRVRGAPAGCAAWPLLQRQRAVPRGLRPQGCRLHLRQGAPGESAGGGLGLAVRSLRITQLTSPQTCMDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVGGVRAQLMHITGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 760767 - protein, 66 aa, Homo sapiens
MQEEVGRLPRGGGHDSDPQGTHWTRPEALCLQVYRRYGEEYGNLTRPDITFTYFQPKPRQAWVWAA

SEQ ID NO: 760768 - protein, 1427 aa, Homo sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 760769 - protein, 320 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 760770 - protein, 318 aa, Homo sapiens
PRHNPRLVRGWVCNRPRLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 760771 - protein, 346 aa, Homo sapiens
GVGREAKDAVAGAAAWAFGAYLVSHRLPGYESVTVARIVPLLRGISLSTISDRAFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 760772 - protein, 118 aa, Homo sapiens
LVYRGVRTRRALRGGVRCLGWWPPTRPRDGAPRVPRAQKIELKCPPPNSALKATSLEVGEAGELKFPPPPHRARTQRGFFHAAPFSETHCDGRSVFLGGPELNLEGLGSAFSRPPPWG

SEQ ID NO: 760773 - protein, 320 aa, Homo sapiens; identical to SEQ ID NO: 760769

SEQ ID NO: 760774 - protein, 325 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPNPVHSGPKCSRCNRNPPPTRFPVQDHFL

SEQ ID NO: 760775 - protein, 282 aa, Homo sapiens
MELLSPPLRDVDLTAPDGSLCSFATTDDFYDDPCFDSPDLRFFEDLDPRLMHVGALLKPEEHSHFPAAVHPAPGAREDEHRRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 760776 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760777 - protein, 863 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEELPGPRQGQWLGQTSEMSRALTPHPCVQDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760778 - protein, 769 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPAGRIPSGQVSQTQLTAAWAPGCPQSWRRMPSSCPALARHPSPSSQCWRRMKRSRCPGSPITAQRPVASPLWSRPMCSRGTQEQFPPSPNPSLAPAIRSFMGSCWAAPQAQGQGTISAVTPLSPSWRASPPAPSPMRTSGSRPAPWGPW

SEQ ID NO: 760779 - protein, 783 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQAGPPRRSAYFKDQIMLHPAPPNGLLCLFPITSVL

SEQ ID NO: 760780 - protein, 161 aa, Homo sapiens
SWPELWDTGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGRSYTYPKQCTGILRVL

SEQ ID NO: 760781 - protein, 704 aa, Homo sapiens
MNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760782 - protein, 836 aa, Homo sapiens; identical to SEQ ID NO: 760776

SEQ ID NO: 760783 - protein, 836 aa, Homo sapiens; identical to SEQ ID NO: 760776

SEQ ID NO: 760784 - protein, 873 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFCESILSSPTAPEGLEGGAQLPRRQFTIQAYADRTPLPAAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760785 - protein, 399 aa, Homo sapiens [sequence omitted]

SEQ ID NO: 760786 - protein, 368 aa, Homo sapiens
STMEDVSTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760787 - protein, 392 aa, Homo sapiens
RSDYAARSDYAARSDYAARSDYAARSDYAARSDYAARSDYAAQSDYAENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760788 - protein, 312 aa, Homo sapiens
MAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760789 - protein, 593 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSLHSGVEREGPGHWPLAGK

SEQ ID NO: 760790 - protein, 586 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSLHSQALRVCPE

SEQ ID NO: 760791 - protein, 201 aa, Homo sapiens
NPTTGHCGTAWLCCSPYSRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760792 - protein, 333 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLTAPNGMYPPPPQQQPPPPPPQMGSLRLL

SEQ ID NO: 760793 - protein, 118 aa, Homo sapiens [sequence omitted]

SEQ ID NO: 760794 - protein, 127 aa, Homo sapiens
ALEWPSDPRLRVLSTPHQVGPLPLEALQYELCGLLPATAYTLQIRCIRWPLPGHWSDWSPSLELRTTERGKEVMRGWEQPTVSSPGPRPLPNWHPLFLFHPQPPLSDWTHGGGRGSWTPGQCSCSGR

SEQ ID NO: 760795 - protein, 110 aa, Homo sapiens
VERERGVGENGRATGFLLKENIRPFQLYEIIVTPLYQDTMGPSQHVYAYSQEMAPSHAPELHLKHIGKTWAQLEWVPEPPELGKSPLTHYTIFWTNAQNQSFSANPSLGQ

SEQ ID NO: 760796 - protein, 773 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760797 - protein, 723 aa, Homo sapiens
RAGAHSLGTQLGFCLELLLQLQFLCHELDCSVSIPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760798 - protein, 892 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPVRGDGGWAEMAVWRVPHPKDADFESSWGLTLNPLSEGGDPAFPTCILTSSGPALTAEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760799 - protein, 358 aa, Homo sapiens
SWPELWDTGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760800 - protein, 364 aa, Homo sapiens
VERERGVGENGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760801 - protein, 626 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLCSWPGLWSWGVG

SEQ ID NO: 760802 - protein, 319 aa, Homo sapiens
VKLPPWQLSTPFQPFWVCGGTEDRLTEGLVLSVGPEDGVVGKGALPQLIRGDGGWAEMAVWRVPHPKDADFESSWGLTLNPLSEGGDPAFPTCILTSSGPALTAEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 760803 - protein, 514 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVISRWVACVPPPKLPDAKIKAKPKGTPLGKGDLGNTNGHTCGGTEGPNTGWVYLH

SEQ ID NO: 760804 - protein, 226 aa, Homo sapiens [sequence omitted]

SEQ ID NO: 760805 - protein, 294 aa, Homo sapiens
QAAGGKEAMAEEREPELYLKWKHCETPGVKTLCNLKHCETPGVKTLCNLKKLLNRLQKDHREDVYLYISGHLNPNKLYQPPETILQHWPNAHRPKGERASEVGEPPAGKVARMKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKNCCTLRPQSSQTGRLWHSSRQILGQSWNGEP

SEQ ID NO: 760806 - protein, 317 aa, Homo sapiens
MTTKLSASTFIKSEVLYFVSVTLKAGAINVILRMGVCGEVYLKWKHCETPGVKTLCNLKHCETPGVKTLCNLKKLLNRLQKDHREDVYLYISGHLNPNKLYQPPETILQHWPNAHRPKGERASEVGEPPAGKVARMKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKNCCTLRPQSSQTGRLWHSSRQILGQSWNGEP

SEQ ID NO: 760807 - protein, 404 aa, Homo sapiens
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 760808 - protein, 404 aa, Homo sapiens; identical to SEQ ID NO: 760807

SEQ ID NO: 760809 - protein, 404 aa, Homo sapiens; identical to SEQ ID NO: 760807

SEQ ID NO: 760810 - protein, 114 aa, Homo sapiens
IQAKSALAMPLYCIATRSHIACKFAELKEKIDCRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 760811 - protein, 364 aa, Homo sapiens
LRLSGHLKEPWEDGDVAYGCSCLRKYPLAAGPAMLSSPLPGSPSFSDKMSYQKKQPTPQPPVDCVKTSGGGGGGGGGGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 760812 - protein, 334 aa, Homo sapiens
LSSLTLPGALGSPSFSDKMSYQKKQPTPQPPVDCVKTSGGGGGGGGGGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 760813 - protein, 547 aa, Homo sapiens
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRKHVFVLSEAGKPIYSRYGSVEALSATMGVMTALVSFVQSAGDAIRAIYAEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 760814 - protein, 547 aa, Homo sapiens; identical to SEQ ID NO: 760813

SEQ ID NO: 760815 - protein, 547 aa, Homo sapiens; identical to SEQ ID NO: 760813

SEQ ID NO: 760816 - protein, 281 aa, Homo sapiens
NVYVSCSPLSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 760817 - protein, 145 aa, Homo sapiens
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSHGSGCRTCTTACMLVSTAPPDPCASFTTWLRRRHYWPG

SEQ ID NO: 760818 - protein, 547 aa, Homo sapiens; identical to SEQ ID NO: 760813

SEQ ID NO: 760819 - protein, 547 aa, Homo sapiens; identical to SEQ ID NO: 760813

SEQ ID NO: 760820 - protein, 547 aa, Homo sapiens; identical to SEQ ID NO: 760813

SEQ ID NO: 760821 - protein, 547 aa, Homo sapiens; identical to SEQ ID NO: 760813

SEQ ID NO: 760822 - protein, 547 aa, Homo sapiens; identical to SEQ ID NO: 760813

SEQ ID NO: 760823 - protein, 547 aa, Homo sapiens; identical to SEQ ID NO: 760813

SEQ ID NO: 760824 - protein, 152 aa, Homo sapiens
SGDFHATESQTVLNVSKGEAKPTRADAHVNRVPEGKAKSLPVQGLSETVGILHKVKSQKCLMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 760825 - protein, 152 aa, Homo sapiens; identical to SEQ ID NO: 760824

SEQ ID NO: 760826 - protein, 152 aa, Homo sapiens; identical to SEQ ID NO: 760824

SEQ ID NO: 760827 - protein, 152 aa, Homo sapiens; identical to SEQ ID NO: 760824

SEQ ID NO: 760828 - protein, 152 aa, Homo sapiens; identical to SEQ ID NO: 760824

SEQ ID NO: 760829 - protein, 152 aa, Homo sapiens; identical to SEQ ID NO: 760824

SEQ ID NO: 760830 - protein, 152 aa, Homo sapiens; identical to SEQ ID NO: 760824

SEQ ID NO: 760831 - protein, 152 aa, Homo sapiens; identical to SEQ ID NO: 760824

SEQ ID NO: 760832 - protein, 152 aa, Homo sapiens; identical to SEQ ID NO: 760824

SEQ ID NO: 760833 - protein, 152 aa, Homo sapiens; identical to SEQ ID NO: 760824

SEQ ID NO: 760834 - protein, 294 aa, Homo sapiens
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLCIIIFSGVAVSIAAIISSFFLATVVQCLQRCAPNKDAEDEDEDKDD

SEQ ID NO: 760835 - protein, 45 aa, Homo sapiens
VPSARGSVLSAQQDRKSPGQETPGPRNTSARHSKDSAFMVTLQSQ

SEQ ID NO: 760836 - protein, 75 aa, Homo sapiens
ACSENRDDLQGIQLCNFKYKLSRTPFLIQMKNDSSPPQRRDIFIRRGNGLPRQVLPLQVLSVSSGLPEWLRAEWG

SEQ ID NO: 760837 - protein, 186 aa, Homo sapiens
MPSGCGESSAGNRYVEGMVGLFYNSDQAMKDDLELQAWCREMTETGLQRAQDQGFLISLESRAQLCHFVTMCIFTCTGQHASNHLGQLDWYSWIPNGPCTMQKPPPISKDVTEKDIVDLLPNLHQARMQKTFTKFLGRRQPVMHEEKYFSGPEPQAVLRQFQEELASMDKEIEVRNAVLDLPCEYL

SEQ ID NO: 760838 - protein, 171 aa, Homo sapiens [sequence omitted]

SEQ ID NO: 760839 - protein, 120 aa, Homo sapiens [sequence omitted]

SEQ ID NO: 760840 - protein, 621 aa, Homo sapiens
MGKYTVRVATGDLLLAGSPNLVQLWLVGEHGEADLGKQLPPVWGKEAEFEIDVPLHLGRLLMVKLRKHNVLLSLDWFCKWISVQGPGTQGEAFFPCYRWVQGHGIICLPEGTGGAPGKMGYILPIAGNRQPDLPRDERFLEDKDLDFNVSLAKGLKDLAIKGTLDFINCVKRLEDFKKIFPHGKTVLAERVYDSWKNDAFFGYQFLNGANPMLLRCSSRLPACLVLPPGMEDLKTQLEKELQAGSLFEVDFSLLDGVKPNVIIFKQQCVAAPLVMLKLQPDGGLLPMVIQLQPPCHGCPPPLLFLPSHPPMAWLLAKTWVRSSDFQLQQLQSHLLRGHLIAEVIAVATMRSLPSLHPIYKLLIPHFRYTMAINTLAQSSLVSEWGIFDLVVSTGSGSHVDILQRAMACLTYHSLCPPDDLADRGLLDVKSSFYGKMPSGCGESSAGNRYVEGMVGLFYNSDQAMKDDLELQAWCREMTETGLQRAQDQGFLISLESRAQLCHFVTMCIFTCTGQHASNHLGQLDWYSWIPNGPCTMQKPPPISKDVTEKDIVDLLPNLHQARMQKTFTKFLGRRQPVMHEEKYFSGPEPQAVLRQFQEELASMDKEIEVRNAVLDLPCEYL

SEQ ID NO: 760841 - protein, 193 aa, Homo sapiens
MAKMPSGCGESSAGNRYVEGMVGLFYNSDQAMKDDLELQAWCREMTETGLQRAQDQGFLISLESRAQLCHFVTMCIFTCTGQHASNHLGQLDWYSWIPNGPCTMQKPPPISKDVTEKDIVDLLPNLHQARMQKTFTKFLGRRQPVMHEEKYFSGPEPQAVLRQFQEELASMDKEIEVRNAVLDLPFFHQYIHP

SEQ ID NO: 760842 - protein, 476 aa, Homo sapiens
SGRTHAQRPEMQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPPCDLVFSTPQNPPTI

SEQ ID NO: 760843 - protein, 1308 aa, Homo sapiens
SGRTHAQRPEMQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEQRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFR

SEQ ID NO: 760844 - protein, 1433 aa, Homo sapiens
SGRTHAQRPEMQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEQRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVVLHMKGGGCALGSGLGPPQGRQRQEFVRQMAEPNDCPLKVQVQGEPWAHLGPPAMPRLTAAFCPMPSSPPHEASPPQQRRNPSGRTAPPRWQVRGSRAWSVSAGQRGPMGALGQTTGTWVPASRATWRCWGTLKRSQFPSRVIQNKNHTKPQSK

SEQ ID NO: 760845 - protein, 181 aa, Homo sapiens
MTFFTHLWDGDPVSQVAGSPTEIPFSSKQEDMSELLDEILVQEILDLNKTTPSEMPSTASTLSTPLHAGIDENYQAGGSENYHELLENLQFSPGIEDKISNDEANANANLHGDPSENYRGPQVSPGSEKSVSSKEKNSKNTQYENLSILDQILQNIGRSSGNIFHKEQQRTSAQRRSQGSQ

SEQ ID NO: 760846 - protein, 183 aa, Homo sapiens
MLWLLPTDRGRSGNGNEPQGSPTEIPFSSKQEDMSELLDEILVQEILDLNKTTPSEMPSTASTLSTPLHAGIDENYQAGGSENYHELLENLQFSPGIEDKISNDEANANANLHGDPSENYRGPQVSPGSEKSVSSKEKNSKNTQYENLSILDQILQNIGRSSGNIFHKEQQRTSAQRRSQGSQ

SEQ ID NO: 760847 - protein, 212 aa, Homo sapiens
MGNCQPSEHPSPSAGGSMAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEDKISNDEANANANLHGDPSENYRGPQVSPGSEKSVSSKEKNSKNTQYENLSILDQILQNIGRSSGNIFHKEQQRTSAQRRSQGSQ

SEQ ID NO: 760848 - protein, 164 aa, Homo sapiens [sequence omitted]

SEQ ID NO: 760849 - protein, 122 aa, Homo sapiens
KPRRNSQMSQKGKKKFSEKNFRGKSCAILKSFEGCKVPRFSHLLHTFFSDFFSMFNICEMTSFLYLKLDASGFVGEGLVVFTFSCERKFVPKGLLPGELFKPSQADLSGFTVLFATIFNMQK

SEQ ID NO: 760850 - protein, 708 aa, Homo sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 760851 - protein, 708 aa, Homo sapiens; identical to SEQ ID NO: 760850

SEQ ID NO: 760852 - protein, 588 aa, Homo sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLKPHTG

SEQ ID NO: 760853 - protein, 708 aa, Homo sapiens; identical to SEQ ID NO: 760850

SEQ ID NO: 760854 - protein, 199 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 760855 - protein, 199 aa, Homo sapiens; identical to SEQ ID NO: 760854

SEQ ID NO: 760856 - protein, 199 aa, Homo sapiens; identical to SEQ ID NO: 760854

SEQ ID NO: 760857 - protein, 138 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMASCAEDLMAVGYRVSS

SEQ ID NO: 760858 - protein, 199 aa, Homo sapiens; identical to SEQ ID NO: 760854

SEQ ID NO: 760859 - protein, 138 aa, Homo sapiens; identical to SEQ ID NO: 760857

SEQ ID NO: 760860 - protein, 199 aa, Homo sapiens; identical to SEQ ID NO: 760854

SEQ ID NO: 760861 - protein, 143 aa, Homo sapiens
MDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 760862 - protein, 667 aa, Homo sapiens
TSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 760863 - protein, 667 aa, Homo sapiens; identical to SEQ ID NO: 760862

SEQ ID NO: 760864 - protein, 593 aa, Homo sapiens
TSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLPFSSSKKFFKNVTISYPALLGQIFSVLLESGLYHAFCLENLLIAKTYYNIPP

SEQ ID NO: 760865 - protein, 470 aa, Homo sapiens [sequence omitted]

SEQ ID NO: 760866 - protein, 452 aa, Homo sapiens
MKFLLILLLQATASGALPLNSSTSLEKNNVLFGERYLEKFYGLEINKLPVTKMKYSGNLMKETSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISSLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 760867 - protein, 448 aa, Homo sapiens
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760868 - protein, 448 aa, Homo sapiens; identical to SEQ ID NO: 760867

SEQ ID NO: 760869 - protein, 372 aa, Homo sapiens
MDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760870 - protein, 356 aa, Homo sapiens
MQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760871 - protein, 395 aa, Homo sapiens
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVMWWQGRKSISDSPWFILPEGSWELGRC

SEQ ID NO: 760872 - protein, 448 aa, Homo sapiens; identical to SEQ ID NO: 760867

SEQ ID NO: 760873 - protein, 193 aa, Homo sapiens
VDPPGCWNSARWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760874 - protein, 448 aa, Homo sapiens; identical to SEQ ID NO: 760867

SEQ ID NO: 760875 - protein, 448 aa, Homo sapiens; identical to SEQ ID NO: 760867

SEQ ID NO: 760876 - protein, 372 aa, Homo sapiens; identical to SEQ ID NO: 760869

SEQ ID NO: 760877 - protein, 356 aa, Homo sapiens; identical to SEQ ID NO: 760870

SEQ ID NO: 760878 - protein, 484 aa, Homo sapiens
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTRKKQACMDRSHPVEAEAAALCWPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760879 - protein, 288 aa, Homo sapiens
SCVYDGLWELHPCESRVVQNILDHNLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760880 - protein, 103 aa, Homo sapiens
LPPPSTSLPSTSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 760881 - protein, 144 aa, Homo sapiens
APRDIPPTNPRVEGSLCFPPSQSLNQKNNAFLFQDIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 760882 - protein, 66 aa, Homo sapiens
MHSNRGEEEQYEILRGYPDLPDYSSRGPCGDSPVRLPRLCASYINAEPRFFTFPIITNRGNKRRNN

SEQ ID NO: 760883 - protein, 144 aa, Homo sapiens; identical to SEQ ID NO: 760881

SEQ ID NO: 760884 - protein, 1244 aa, Homo sapiens
EFREPAEAAAAARTGVRVRGRPPRAQGGAGKFRRTGGAAVGERRAGGGGPGSGPGARSRPELVGRVPAGGAGLAGEGRLGVQEANWLPGVQEGQVVRAVRKPTCTGRSPRRERDPARAQDPEAPAEEEVVTGRPGPHGTSGAEGDAGCRGMGSRAQKSAGNAELWEPLPEGRPRPAGTSSAVSAWASLKLCLRGGSGRRQRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760885 - protein, 455 aa, Homo sapiens
HEGERTWSRPAATFWAPGALPTTSAEMRLESQRACLKESPEPVRPPGVGRCPHPVLEDPLLLLLPGMEQGQGCGRLGALPCPSLPHQRCPCTSWQGHDSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 760886 - protein, 112 aa, Homo sapiens
MRVRAGVCGVAGAGREGGAGLGGDSDLGWAVPSLSTQLGVGPLSHRLHACRSLSGTLLEASIRLWVHVWGCALDGVWASSQAAPLTVWQNQDLSGSRSRGSPGGPSGVGLSD

SEQ ID NO: 760887 - protein, 1070 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760888 - protein, 1128 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDETPPSCDVRSGSVDWEAGGLCFRPKTTPGFLQDEGALMRFCHPSTRFPCSLDPALSSHRLYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760889 - protein, 1041 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSLVPASCPSSGMARRSAAPTITCCPSDHPTWSATSASCVRPRAPRSLPPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760890 - protein, 761 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSR

SEQ ID NO: 760891 - protein, 630 aa, Homo sapiens
MAFTVPSLSRRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760892 - protein, 1070 aa, Homo sapiens; identical to SEQ ID NO: 760887

SEQ ID NO: 760893 - protein, 548 aa, Homo sapiens
MDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760894 - protein, 817 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQPGDPGPWPAGWSLHPAHRPGWQEGQQHPLLLAARATILPGALPALPA

SEQ ID NO: 760895 - protein, 328 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAW

SEQ ID NO: 760896 - protein, 473 aa, Homo sapiens
EFREPAEAAAAARTGVRVRGRPPRAQGGAGKFRRTGGAAVGERRAGGGGPGSGPGARSRPELVGRVPAGGAGLAGEGRLGVQEANWLPGVQEGQVVRAVRKPTCTGRSPRRERDPARAQDPEAPAEEEVVTGRPGPHGTSGAEGDAGCRGMGSRAQKSAGNAELWEPLPEGRPRPAGTSSAVSAWASLKLCLRGGSGRRQRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATHGLLV

SEQ ID NO: 760897 - protein, 112 aa, Homo sapiens; identical to SEQ ID NO: 760886

SEQ ID NO: 760898 - protein, 1098 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMASVSQIASRERPEKLQDSYEVPRQQARKVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760899 - protein, 1060 aa, Homo sapiens
FEQESGPSCHRSEVKERLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760900 - protein, 1025 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVVSVAVKCLKPDVLSQPEAMDDFIREVNAMHSLDHRNLIRLYGVVLTPPMKMASVSQIASRERPEKLQDSYEVPRQQARKVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTAPACASAAAPTQHPSPRRPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760901 - protein, 719 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 760902 - protein, 668 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFAPSWARGSLPGPARARPTTPLCLSRRGRPLPWRTTCSSRPRVGASRPAPHRPQRSSRRYSRSA

SEQ ID NO: 760903 - protein, 1070 aa, Homo sapiens; identical to SEQ ID NO: 760887

SEQ ID NO: 760904 - protein, 328 aa, Homo sapiens; identical to SEQ ID NO: 760895

SEQ ID NO: 760905 - protein, 255 aa, Homo sapiens
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAW

SEQ ID NO: 760906 - protein, 1238 aa, Homo sapiens [sequence omitted]

SEQ ID NO: 760907 - protein, 199 aa, Homo sapiens
TAETARSPCRLRAPGRGLYVLTPHCVCSQQCGHRWGPLSQPQVSSGPRPLLGTARLAASWFPAPWLGDRAARISWARVRGPLVRSLAQPGRLEAQCAGGGHTAVSHLQLFPGPHLECPVSLTLYKLFSNCQAENNGVFSDSCYFCKVSVRGTRCMKGESKGCLRRHQIVAFVTRGCALFTESSFYSSLGFLCGSRPKCR

SEQ ID NO: 760908 - protein, 1265 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDKCASSPCHSGGLCEDLADGFHCHCPQGFSGPLCEVDVDLCEPSPCRNGARCYNLEGDYYCACPDDFGGKNCSVPREPCPGGACRGAGLRHGVVGEVVGQGRACLLTVLPAIVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760909 - protein, 290 aa, Homo sapiens
MLGRGWGLILAEARSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760910 - protein, 430 aa, Homo sapiens
LIRSGILGSGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760911 - protein, 1334 aa, Homo sapiens
HAYAGARVTNGRASCQSRSELVGCGAGSAGAQSPRPGPAAFTAAAVAAGWEPGRAAGARPPASRSCRRPCTPAAQARAPDAALDPARAAAAAASAAAAASAGARRAGGRWEAGAAAGSRARAAAAGPGGRVAGAMRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDVNDCRGQCQHGGTCKDLVNGYQCVCPRGFGGRHCELERDKCASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760912 - protein, 1244 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDKCASSPCHSGGLCEDLADGFHCHCPQGFSGPLCEAPPTLQVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760913 - protein, 884 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDKCASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPWWWHPGGHSRGGWDLAYNGGPPDAHPLLCSYNGGICVDGVNWFRCECAPGFAGPDCRISEWPDSPSPGSPSAQPRCQESGDINVHVP

SEQ ID NO: 760914 - protein, 345 aa, Homo sapiens
RLTLLCVPAQVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 760915 - protein, 234 aa, Homo sapiens
VTLRIFGRSDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRPSGRSARTMQNLNDRLASYLDKVRALEEANADLEVKIRDWYQRQRPAEIKDYSPYFKTIEDLRNKILTATVDNANVLLQIDNARLAADDFRTKYETELNLRMSVEADINGLRRVLDELDLVRA

SEQ ID NO: 760916 - protein, 271 aa, Homo sapiens
LVRGWVCIGRGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGYYADDRRGAEEDMTRRERGRGDGEPKAGGAQ

SEQ ID NO: 760917 - protein, 373 aa, Homo sapiens
MDYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPADPTDTYGHKRYRTKGQEGHSPIKAPQSSACHSGARGGAGPAAKPAGEGYAVPVIQRHEHSTAEQHQQQHSNTSTRPSATAKHTSIPSTDMDRDIKGQGAEQLPAVCPWGGQPKPP

SEQ ID NO: 760918 - protein, 97 aa, Homo sapiens
FIDATSMVAQAMGVGGSGGGGRGGFPSGGGGGGGQQRAGDWKCPNPTCENMNFSWRNECNQCKAPKPDGPGGGPGGSHMGGNYGDDRRASITPYDIR

SEQ ID NO: 760919 - protein, 561 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 760920 - protein, 561 aa, Homo sapiens; identical to SEQ ID NO: 760919

SEQ ID NO: 760921 - protein, 561 aa, Homo sapiens; identical to SEQ ID NO: 760919

SEQ ID NO: 760922 - protein, 290 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMG

SEQ ID NO: 760923 - protein, 290 aa, Homo sapiens; identical to SEQ ID NO: 760922

SEQ ID NO: 760924 - protein, 561 aa, Homo sapiens; identical to SEQ ID NO: 760919

SEQ ID NO: 760925 - protein, 561 aa, Homo sapiens; identical to SEQ ID NO: 760919

SEQ ID NO: 760926 - protein, 561 aa, Homo sapiens; identical to SEQ ID NO: 760919

SEQ ID NO: 760927 - protein, 290 aa, Homo sapiens; identical to SEQ ID NO: 760922

SEQ ID NO: 760928 - protein, 495 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNHRWPRRGTRWLSHGG

SEQ ID NO: 760929 - protein, 516 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRPVAVWRVPG

SEQ ID NO: 760930 - protein, 524 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGSEHKVGENIRVGQT

SEQ ID NO: 760931 - protein, 290 aa, Homo sapiens; identical to SEQ ID NO: 760922

SEQ ID NO: 760932 - protein, 290 aa, Homo sapiens; identical to SEQ ID NO: 760922

SEQ ID NO: 760933 - protein, 290 aa, Homo sapiens; identical to SEQ ID NO: 760922

SEQ ID NO: 760934 - protein, 290 aa, Homo sapiens; identical to SEQ ID NO: 760922

SEQ ID NO: 760935 - protein, 419 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPADPTDTYGHKRYRTKGQEGHCHIKAPQSSACHSGARGGAGPAAKPAGEGYAVPVIQRHEHSTAEQHQQQHSNTSTRPSATAKHTSIPSTDMDRDIKGQGAEQLPAVCPWGGQPKPP

SEQ ID NO: 760936 - protein, 405 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGVFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 760937 - protein, 244 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSTPGPLSSFIPCLMLREAQNKLFVTLK

SEQ ID NO: 760938 - protein, 174 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNSESFSAGHLFLLFLNIAFLFLVFWRRSLVLLPRLECSGAVSAHCNISLPGSNDSPASATEEAEAGGSLEFRSLGLQ

SEQ ID NO: 760939 - protein, 216 aa, Homo sapiens
SLAPISVGHKRLRLQVPSQEANSVAFSSLMGEDCAHLASQQDNSDNNTIFVQGLGENVTIESVADYFKQIGIIKTNKKTGQPMINLYTDRETGKLKGEDAASLLPSVLCMAIIGVEVSLISHGGVVISRLLMRYWEVGINRGGDRMISTAAGRPRMVGAMNEANRFSFISVPDGRKMRLFVPSGPHESTSSVTVQSPQILSTWLSTSSSLLMGEDG

SEQ ID NO: 760940 - protein, 561 aa, Homo sapiens; identical to SEQ ID NO: 760919

SEQ ID NO: 760941 - protein, 343 aa, Homo sapiens
MSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 760942 - protein, 549 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSR

SEQ ID NO: 760943 - protein, 321 aa, Homo sapiens
MAIKTRVVEVAAVAMDSRTVEAAAGVAVVAAAAAAVVVTTAAVVAMNPEVVEVAVEAEVAWGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 760944 - protein, 526 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGWWGQRWLWPWQDGFQG

SEQ ID NO: 760945 - protein, 590 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGRGGMIAVRGGGTRAPRGGGGTEGLAGRCSGEPTTGKGIKPARWEAGDQSRLTTARVGERKPPRGKKKQGTGNEIRRRVTNS

SEQ ID NO: 760946 - protein, 581 aa, Homo sapiens
RRYRFGIPGLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPLLKYEILLGNECNQCKAPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 760947 - protein, 290 aa, Homo sapiens; identical to SEQ ID NO: 760922

SEQ ID NO: 760948 - protein, 341 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGAVARSSFGKFLLELLSDSSNSSCITWEGTNGEFKMTDPDE

SEQ ID NO: 760949 - protein, 497 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGVFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 760950 - protein, 344 aa, Homo sapiens
PPVPVRNSRLLSPPGVGAQRCWNFVACLPVRACADMASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGVAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENR

SEQ ID NO: 760951 - protein, 77 aa, Homo sapiens
TAGTGSEFPAAQSSRRRCSAVLELRCLLACARVRGHGLKRLYPTSNPKVSAIFGLPEFVEGKGGHAMFSDHAGFPFI

SEQ ID NO: 760952 - protein, 712 aa, Homo sapiens
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 760953 - protein, 712 aa, Homo sapiens; identical to SEQ ID NO: 760952

SEQ ID NO: 760954 - protein, 712 aa, Homo sapiens
QDTGKPQKPSSPAMKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVSNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 760955 - protein, 704 aa, Homo sapiens
QDTGKPQKPSSPAMKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVVTKTSELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 760956 - protein, 240 aa, Homo sapiens
QDTGKPQKPSSPAMKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTL

SEQ ID NO: 760957 - protein, 997 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 760958 - protein, 976 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 760959 - protein, 915 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIR

SEQ ID NO: 760960 - protein, 495 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGVHFSQTFLLLNLKQTTVKN

SEQ ID NO: 760961 - protein, 494 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKYEEGKKRRKPNYSSVDLSEVEWEDRDDVLRNAMVNRKTGKFSMEVKKTVDKGVHFSQTFLLLNLKQTTVKN

SEQ ID NO: 760962 - protein, 973 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 760963 - protein, 794 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRPRTTTFSSTFLQDGF

SEQ ID NO: 760964 - protein, 299 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKEPKA

SEQ ID NO: 760965 - protein, 233 aa, Homo sapiens
MNVHGDGEAGLQVRTSQSRNPGGRRPGRQSRARIPKMAAVKDSCGKGEMATGNGRRLHLGIPEAVFVEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 760966 - protein, 205 aa, Homo sapiens
WLGQACVIGRGVKDSCGKGEMATGNGRRLHLGIPEAVFVEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 760967 - protein, 160 aa, Homo sapiens
MKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 760968 - protein, 233 aa, Homo sapiens; identical to SEQ ID NO: 760965

SEQ ID NO: 760969 - protein, 77 aa, Homo sapiens
ACHLRERSQSALEVGIFRPKENGDLWGRSCAPMNVHGDGEAGLQVRTSQSRNPGGRRPGRQSRARIPKMAAVKDKES

SEQ ID NO: 760970 - protein, 217 aa, Homo sapiens
MNVHGDGEAGLQVRTSQSRNPGGRRPGRQSRARIPKMAAVKDSCGKGEMATGNGRRLHLGIPEAVFVEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVKHLEQEY

SEQ ID NO: 760971 - protein, 205 aa, Homo sapiens; identical to SEQ ID NO: 760966

SEQ ID NO: 760972 - protein, 107 aa, Homo sapiens
MQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 760973 - protein, 460 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 760974 - protein, 403 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGIFF

SEQ ID NO: 760975 - protein, 446 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDDTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 760976 - protein, 195 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKELSWKTGKTTNIILNILFTWEITKPTIRYI

SEQ ID NO: 760977 - protein, 185 aa, Homo sapiens
QKKTVPRCLKLKIKIKMFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKVSRK

SEQ ID NO: 760978 - protein, 226 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSGKHDGAFC

SEQ ID NO: 760979 - protein, 460 aa, Homo sapiens; identical to SEQ ID NO: 760973

SEQ ID NO: 760980 - protein, 442 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSREFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 760981 - protein, 170 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTNINN

SEQ ID NO: 760982 - protein, 132 aa, Homo sapiens
MTGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 760983 - protein, 132 aa, Homo sapiens; identical to SEQ ID NO: 760982

SEQ ID NO: 760984 - protein, 84 aa, Homo sapiens
QIQENYQKPLEELEVLKEAASHVLSKHNNELKAAEALVREAEAKMQESNHLLLMVNANLREFSDKKLHVQEEQNLTSELIVQGR

SEQ ID NO: 760985 - protein, 507 aa, Homo sapiens
KVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 760986 - protein, 538 aa, Homo sapiens
KVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 760987 - protein, 206 aa, Homo sapiens
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPAKFRLCHHCVTQLDCVELHVPAVSDIHPGVSVVARFALLQLLTLRNLLTGV

SEQ ID NO: 760988 - protein, 206 aa, Homo sapiens; identical to SEQ ID NO: 760987

SEQ ID NO: 760989 - protein, 206 aa, Homo sapiens; identical to SEQ ID NO: 760987

SEQ ID NO: 760990 - protein, 207 aa, Homo sapiens
MFPGPISEGATMTLQCTKSAGPWKMVVWDEDGFQGRRHEFTAECPSVLELGFETVRSLKVLSGAWVGFEHAGFQGQQYILERGEYPSWDAWGGNTAYPAERLTSFRPAACANHRDSRLTIFEQENFLGKKGELSDDYPSLQAMGWEGNEVGSFHVHSGAWVCSQFPGYRGFQYVLECDHHSGDYKHFREWGSHAPTFQVQSIRRIQQ

SEQ ID NO: 760991 - protein, 179 aa, Homo sapiens
QHHLQKLEGRRLDFDKKKRQGKIPDEELRQALEKFEDSKEVAETSMHNLLETDIEQMSQLRALAEAQLNDHWQAMQILDELAEKLKRRMREASSRPKREYKPKFWEPFDLGEPEQSNGGFPCTTVPKIAASSPFQSSNKSICTPSRSMPPLDQPSCKVLYDFQPENHGELGFHEGDVFT

SEQ ID NO: 760992 - protein, 153 aa, Homo sapiens
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 760993 - protein, 404 aa, Homo sapiens
MFVGLFSLLSFNVFRSGDGVAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTDGMISAHCNLRLPDSRDSPAQPLE

SEQ ID NO: 760994 - protein, 702 aa, Homo sapiens
MFVGLFSLLSFNVFRSGDGVAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 760995 - protein, 97 aa, Homo sapiens
LVVEMSWDKGERTEPLEKTELPEGAPELALDTELSLEDGDRCKAKVLGPSGPDGQGCNPARGVGGLDIHRSWDIRAWRPEGETKTSTLSYRHEERLS

SEQ ID NO: 760996 - protein, 232 aa, Homo sapiens
MGLALIAQAGVQWCDFGSLQPPPPGFKRFSCLSLLSSCDYSLLLEHPSFLRLKNIPLSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 760997 - protein, 191 aa, Homo sapiens
ACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 760998 - protein, 301 aa, Homo sapiens [sequence omitted]

SEQ ID NO: 760999 - protein, 144 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 761000 - protein, 79 aa, Homo sapiens
GVCSQSICCGRAPDPKHLQRSIINGAVQLKLTSARSPPRALHLSQPTASTVWPCRLSGAQQGEKAKSCPLGQAEVTRRA

SEQ ID NO: 761001 - protein, 233 aa, Homo sapiens
SGFPRRRLLARPSGRRRNLTLSGVWDLGPRHRRGGASAPDYAPAVRSRGQQCWLCSRRRGGMAQRLGEWARGPSDATGLYRAVLLRSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 761002 - protein, 164 aa, Homo sapiens
MYSEIQRERADIGGLMARPEYREWNPELIKPKKLLNPVKASRSHHTQVKVFLQPWGGRPFGFPIGKAKPGKGGGPFCGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 761003 - protein, 144 aa, Homo sapiens; identical to SEQ ID NO: 760999

SEQ ID NO: 761004 - protein, 144 aa, Homo sapiens; identical to SEQ ID NO: 760999

SEQ ID NO: 761005 - protein, 144 aa, Homo sapiens; identical to SEQ ID NO: 760999

SEQ ID NO: 761006 - protein, 149 aa, Homo sapiens
MGQALQQWCRQQCEGYRDVNIYNMATSFRDGLAFCAILHRHRPDLINFSALKKENIYENNKLAFRVAEEHLGIPALLDAEDMVALKVPDRLSILTYVSQYYNYFHGCHRRPWFTFQGSSQLCISSHSNCGGCKSRFSLFQSPLQLRMAM

SEQ ID NO: 761007 - protein, 79 aa, Homo sapiens; identical to SEQ ID NO: 761000

SEQ ID NO: 761008 - protein, 144 aa, Homo sapiens; identical to SEQ ID NO: 760999

SEQ ID NO: 761009 - protein, 67 aa, Homo sapiens
DGSLSPRLDLRTAMYSEIQRERADIGGLMARPEYREWNPELIKPKKLLNPVKASRSHHSQVRRRLLV

SEQ ID NO: 761010 - protein, 144 aa, Homo sapiens; identical to SEQ ID NO: 760999

SEQ ID NO: 761011 - protein, 144 aa, Homo sapiens; identical to SEQ ID NO: 760999

SEQ ID NO: 761012 - protein, 144 aa, Homo sapiens; identical to SEQ ID NO: 760999

SEQ ID NO: 761013 - protein, 135 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQVGDGHPAGTTHPPGLSSREELCCGHS

SEQ ID NO: 761014 - protein, 119 aa, Homo sapiens
GSHRAESPPCAASPGPAAYVGRRRSPWRGGRGLPGESPVPASSPRILGPERPPTGTRRGFLERLGGPSPPGSFLPWRSFCPLRSSLTTTLRSQKTIQRGDEDWEARLSDAHLWLVTRAA

SEQ ID NO: 761015 - protein, 358 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLRPVQLTDHIRAGPS

SEQ ID NO: 761016 - protein, 441 aa, Homo sapiens
ARAQGYRTAAFSYSPPGLCRTPPFSRLECSGMIVTHCSLPLLGSSNPTSGSQSMEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLSTGPIWLNEVFCFGRESSIEECKIRQWGTRACSHSEDAGVTCTL

SEQ ID NO: 761017 - protein, 451 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 761018 - protein, 358 aa, Homo sapiens; identical to SEQ ID NO: 761015

SEQ ID NO: 761019 - protein, 113 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVIRDQLANIVKPHLYKIKHLNPGGGGCRE

SEQ ID NO: 761020 - protein, 451 aa, Homo sapiens; identical to SEQ ID NO: 761017

SEQ ID NO: 761021 - protein, 451 aa, Homo sapiens; identical to SEQ ID NO: 761017

SEQ ID NO: 761022 - protein, 451 aa, Homo sapiens; identical to SEQ ID NO: 761017

SEQ ID NO: 761023 - protein, 136 aa, Homo sapiens
MDTQTHSLPITHTQLHSNSQPQSRTCTRHCQTFSQSCRQSHRGSRSQSSSQSPASHRNPTGAHSSSGHQSQSPNTSPPPKRHKKTMNSHHSPMRPTILHCRCPKNRKNLEGKLKKKKMAKRIQQVYKTKTRSSGTL

SEQ ID NO: 761024 - protein, 138 aa, Homo sapiens
MDTQTHSLPITHTQLHSNSQPQSRTCTRHCQTFSQSCRQSHRGSRSQSSSQSPASHRNPTGAHSSSGHQSQSPNTSPPPKRHKKTMNSHHSPMRPTILHCRCPKNRKNLEGKLKKKKMAKRIQQVYKTKTRSSGWKSN

SEQ ID NO: 761025 - protein, 156 aa, Homo sapiens [sequence omitted]

SEQ ID NO: 761026 - protein, 502 aa, Homo sapiens
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 761027 - protein, 252 aa, Homo sapiens
AGRLRDWGRGCWSRVMLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKKSTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 761028 - protein, 262 aa, Homo sapiens
AGRLRDWGRGCWSRVMLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKKSTITLQQAEYEFLSFVRQQTPPGLCPLAGNSVHEDKKFLDKYMPQFMKHLHYRIIDVSTVKELCRRWYPEEYEFAPKKAASHSIKELQFYRNNIFKKKIDEKKRKIIENGENEKTVRLPLHRYLEATSGGFFFSR

SEQ ID NO: 761029 - protein, 263 aa, Homo sapiens
AGRLRDWGRGCWSRVMLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKKSTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKWVKNATLNINPSSPRGTLFLLGTFG

SEQ ID NO: 761030 - protein, 127 aa, Homo sapiens
GFFTRNTYFPPGTQFLPFFRIFIRLPIGRFGPSRAKNSARGDMCHHAWINFCKDQGFTILARLVSNSWPQVIHPPWPPTVLGLQVWATAPGLDWAILAGFGEAIEEAGIGNLSQGRARRLESSMFSR

SEQ ID NO: 761031 - protein, 211 aa, Homo sapiens
AGRLRDWGRGCWSRVMLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKKSTITLQQAEYEFLSFVRQQTPPGLCPLAGNSVHEDKKFLDKYMPQFMKHLHYRIIDVSTVKELCRRWYPEEYEFAPKKAASHRV

SEQ ID NO: 761032 - protein, 244 aa, Homo sapiens
LRAHASPPQAAAQLTLGAPPAADREGLKAPGSLPPALGNPWPCGDMNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 761033 - protein, 244 aa, Homo sapiens; identical to SEQ ID NO: 761032

SEQ ID NO: 761034 - protein, 244 aa, Homo sapiens; identical to SEQ ID NO: 761032

SEQ ID NO: 761035 - protein, 101 aa, Homo sapiens
MPSARIRSSSSSPWTSPFLCTSSNVGLACRASLGGSGGCSLQRTSLAPGAHLCSLLLTTHPRMYREKNYYALLDHVLRKDRKYLTRDNNKSDAGLCVCCGK

SEQ ID NO: 761036 - protein, 101 aa, Homo sapiens; identical to SEQ ID NO: 761035

SEQ ID NO: 761037 - protein, 558 aa, Homo sapiens
PSSCLCRSRQLAPGRPEDAEGPEPGGPEAEAHSTPSSYPVSPASLRTCCPWARRPLGSRRNSFTLRGRVPPLPTAACGRCRLHPDPEPPPPAMEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 761038 - protein, 87 aa, Homo sapiens
TVTLASSFTPKQRIKARSCSCSEGRECVNCGATATPLWRRDGTGHYLCNACGLYHKMNGQNRPLIKPKRRLFAPPEEPHILPISDAT

SEQ ID NO: 761039 - protein, 572 aa, Homo sapiens
PSSCLCRSRQLAPGRPEDAEGPEPGGPEAEAHSTPSSYPVSPASLRTCCPWARRPLGSRRNSFTLRGRVPPLPTAACGRCRLHPDPEPPPPAMEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 761040 - protein, 572 aa, Homo sapiens; identical to SEQ ID NO: 761039

SEQ ID NO: 761041 - protein, 480 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 761042 - protein, 580 aa, Homo sapiens
PSSCLCRSRQLAPGRPEDAEGPEPGGPEAEAHSTPSSYPVSPASLRTCCPWARRPLGSRRNSFTLRGRVPPLPTAACGRCRLHPDPEPPPPAMEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIQAPPLLEGAQQPASSYCECSPPLRGCLRT

SEQ ID NO: 761043 - protein, 212 aa, Homo sapiens
MIGCCSLFTLSSFSKARSCSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 761044 - protein, 292 aa, Homo sapiens
VERGSLFIGQLGALLLGVAFLSPRRVRFRQRMQQSRILRRTCNRGGGFGQAGSCLRVEEGNPKAWKDLAELLFPFFPLHRIAGKEAGSGLPRPLLKHSLTVLLSPSVRRFSELPSGGRCRLHPDPEPPPPAMEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALCVGPHKTWTEPFQKHGPWCEAGALLCPVGGAGARDQATKGLGTGAQPQGGQQGAAR

SEQ ID NO: 761045 - protein, 480 aa, Homo sapiens; identical to SEQ ID NO: 761041

SEQ ID NO: 761046 - protein, 480 aa, Homo sapiens; identical to SEQ ID NO: 761041

SEQ ID NO: 761047 - protein, 331 aa, Homo sapiens
MSAEGSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 761048 - protein, 572 aa, Homo sapiens; identical to SEQ ID NO: 761039

SEQ ID NO: 761049 - protein, 109 aa, Homo sapiens
LPPQDPEGIEKPSHSSLLGDIARGGGKGLIATPYKLPTQEYPGVLPRRRFSSGSSFALWPMWICAGSPRCHGRAIPLHLYSVSLLYLPVLTPIPYCLEYCNFIINFEVR

SEQ ID NO: 761050 - protein, 269 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761051 - protein, 269 aa, Homo sapiens; identical to SEQ ID NO: 761050

SEQ ID NO: 761052 - protein, 269 aa, Homo sapiens; identical to SEQ ID NO: 761050

SEQ ID NO: 761053 - protein, 269 aa, Homo sapiens; identical to SEQ ID NO: 761050

SEQ ID NO: 761054 - protein, 208 aa, Homo sapiens
MQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761055 - protein, 269 aa, Homo sapiens; identical to SEQ ID NO: 761050

SEQ ID NO: 761056 - protein, 106 aa, Homo sapiens
MNQEDLDPDSTTDVGDVTNTEEELIRECEEMWKDMEECQNKLSLIGTETLTDSNAQLSLLIMQVKCLTAELSQWQKKTPERSHRVVQAGVQWHNHGSLQPRSPGFK

SEQ ID NO: 761057 - protein, 237 aa, Homo sapiens
MTLFQCQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761058 - protein, 218 aa, Homo sapiens
MTLFQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761059 - protein, 296 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEILQMMILSYKPVGCPLNSLQFDIIYLEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761060 - protein, 236 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLERIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761061 - protein, 131 aa, Homo sapiens
MVLSTKESKNEKLKEDLERIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761062 - protein, 224 aa, Homo sapiens
MTLFQCQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVTVGVRMAELRRQR

SEQ ID NO: 761063 - protein, 106 aa, Homo sapiens; identical to SEQ ID NO: 761056

SEQ ID NO: 761064 - protein, 269 aa, Homo sapiens; identical to SEQ ID NO: 761050

SEQ ID NO: 761065 - protein, 269 aa, Homo sapiens; identical to SEQ ID NO: 761050

SEQ ID NO: 761066 - protein, 269 aa, Homo sapiens; identical to SEQ ID NO: 761050

SEQ ID NO: 761067 - protein, 269 aa, Homo sapiens; identical to SEQ ID NO: 761050

SEQ ID NO: 761068 - protein, 271 aa, Homo sapiens
MTLFQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761069 - protein, 205 aa, Homo sapiens
MTLFQVTYSLHLASSSAIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 761070 - protein, 296 aa, Homo sapiens; identical to SEQ ID NO: 761059

SEQ ID NO: 761071 - protein, 167 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRVLILCSRFLK

SEQ ID NO: 761072 - protein, 134 aa, Homo sapiens [sequence omitted]

SEQ ID NO: 761073 - protein, 251 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEILQMMILSYKPVGCPLNSLQFDIIYLEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKMESPCVTQAGMQWHDLVSLQPLPPG

SEQ ID NO: 761074 - protein, 82 aa, Homo sapiens
ENLGWCIPMHLDRPIPELCQVHLEFSKTDVNLKGSILSSCEEKYFKMCKTEESELKEDSDPILAKLERLILLLTLIATCYPT

SEQ ID NO: 761075 - protein, 82 aa, Homo sapiens
MEDALSEVDFQLKVDLHFTDSEQQLRDVAGAPMVSSRTLGLHFHPRNGLHHQVPVMFDYFHLSVISVTVHAALVALQQPLIR

SEQ ID NO: 761076 - protein, 662 aa, Homo sapiens
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 761077 - protein, 202 aa, Homo sapiens
MAYPCGDMNSFSQGLCLSCKKGRCNTLGYHVRQEPRSKSKRLFLVTRAQSPFKVYHYQLKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 761078 - protein, 499 aa, Homo sapiens [sequence omitted]

SEQ ID NO: 761079 - protein, 105 aa, Homo sapiens
LPSPVGVSPSLQPPPPPSTGLSFSSGPQPRPPPTPTPLSPRQFWPFSHIYKCPAGTGGGRGVPGAYRRQCTVAVPSECACACVPCRGCVECIVQHIFMNKIVLNI

SEQ ID NO: 761080 - protein, 280 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 761081 - protein, 166 aa, Homo sapiens
MEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 761082 - protein, 224 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGL

SEQ ID NO: 761083 - protein, 264 aa, Homo sapiens
DLLQFQLMGKWPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 761084 - protein, 375 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGLQLYFSFYMGSKTLRGRNTSSEYQILTARREDSGLYWCEAATEDGNVLKHSPELELQVLGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 761085 - protein, 330 aa, Homo sapiens
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 761086 - protein, 313 aa, Homo sapiens
MAAVDSFYLLYREIARSCNCYMEALALVGAWYTARKSITVICDFYSLIRLHFIPRLGSRADLIKQYGRWAVVSGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 761087 - protein, 330 aa, Homo sapiens; identical to SEQ ID NO: 761085

SEQ ID NO: 761088 - protein, 330 aa, Homo sapiens; identical to SEQ ID NO: 761085

SEQ ID NO: 761089 - protein, 85 aa, Homo sapiens
RVRGSREGAARQQLRRPRRGRRPRGSGGTGLEDFAGLQIGLKRRTEPHTADGPELAERRLPWLLLTVSTSCTGKSPGLAIAIWKL

SEQ ID NO: 761090 - protein, 330 aa, Homo sapiens; identical to SEQ ID NO: 761085

SEQ ID NO: 761091 - protein, 330 aa, Homo sapiens; identical to SEQ ID NO: 761085

SEQ ID NO: 761092 - protein, 575 aa, Homo sapiens
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 761093 - protein, 575 aa, Homo sapiens; identical to SEQ ID NO: 761092

SEQ ID NO: 761094 - protein, 575 aa, Homo sapiens; identical to SEQ ID NO: 761092

SEQ ID NO: 761095 - protein, 575 aa, Homo sapiens; identical to SEQ ID NO: 761092

SEQ ID NO: 761096 - protein, 536 aa, Homo sapiens
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRAYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 761097 - protein, 575 aa, Homo sapiens; identical to SEQ ID NO: 761092

SEQ ID NO: 761098 - protein, 575 aa, Homo sapiens; identical to SEQ ID NO: 761092

SEQ ID NO: 761099 - protein, 572 aa, Homo sapiens
EAARPAIHSRGTYIGCFSDDGHERTLKGAVFYDYEKDDCLPQPGCKDDASGGPGLTPTWALGAIPGLQPGALLPRGMAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPKKCNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 761100 - protein, 124 aa, Homo sapiens
ARNWKTKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 761101 - protein, 406 aa, Homo sapiens
PARGLNFVERGANLAERAASFAESALQGYACGDTGRFGLFHPCGAHYPEPGAVQAPPGPTQGGSSLRSAETFSFAFAKGAPDPCCGATERDCASPSRPTAVGTMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761102 - protein, 336 aa, Homo sapiens
MDCVGWPPGRKWHLEKNTSCGGSSGICASYVTQMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761103 - protein, 303 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761104 - protein, 341 aa, Homo sapiens
STSKLGCWVGTSFKAEGASYAHARRRAPPAKQRLGDHSGCHSGPEADQPCGMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENILLCHPGWSAAASSRKTATSTSQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761105 - protein, 216 aa, Homo sapiens
PARGLNFVERGANLAERAASFAESALQGYACGDTGRFGLFHPCGAHYPEPGAVQAPPGPTQGGSSLRSAETFSFAFAKGAPDPCCGATERDCASPSRPTAVGTMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYND

SEQ ID NO: 761106 - protein, 354 aa, Homo sapiens
STSKLGCWVGTSFKAEGASYAHARRRAPPAKQRLGDHSGCHSGPEADQPCGMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761107 - protein, 406 aa, Homo sapiens; identical to SEQ ID NO: 761101

SEQ ID NO: 761108 - protein, 270 aa, Homo sapiens
MFVSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761109 - protein, 220 aa, Homo sapiens
MGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 761110 - protein, 406 aa, Homo sapiens; identical to SEQ ID NO: 761101

SEQ ID NO: 761111 - protein, 205 aa, Homo sapiens
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 761112 - protein, 280 aa, Homo sapiens
EAEGDRGAGTAERSSDWLDGRSWAIKETPTGLAGRRSEDSDNIFTGEEAKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 761113 - protein, 280 aa, Homo sapiens; identical to SEQ ID NO: 761112

SEQ ID NO: 761114 - protein, 280 aa, Homo sapiens; identical to SEQ ID NO: 761112

SEQ ID NO: 761115 - protein, 259 aa, Homo sapiens
RNTLREMRRRISVPGKEVKLRLNRRTASTYLPVRIPDACLQIPKLFHIIIVHTGILLEIMAGLLALQVSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 761116 - protein, 146 aa, Homo sapiens [sequence omitted]

SEQ ID NO: 761117 - protein, 50 aa, Homo sapiens
RQCIASETASLPMIVSIKEGGRTRPQVVSLPNMRVQKCSCASDGALVPRR

SEQ ID NO: 761118 - protein, 327 aa, Homo sapiens
RVWGRASSRPSAGPAARFPPLAPHSCSHFPPCLLPGLSGPGERGGPGQGPGQGPGRPGLPGSALKPERTAAGKRPSTWTSSRRACCRGWGLRPGPRASSEPRRDVGARVYWPGRCRKAGARNSSACGGHRCVQDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPP

SEQ ID NO: 761119 - protein, 289 aa, Homo sapiens
MLKKHLTKCNSSSQFKLLSKLGKEENFLKGICENPTARIILNDGNLKFFLLSSRTSREGRARWLNRTLQHLSPKQEHQLEQLSTQESTFRRTKTQDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPP

SEQ ID NO: 761120 - protein, 80 aa, Homo sapiens
LPWPLPRWSCCGAVLPACAPAPKRPPPLATHALKPESSRWVVVLVLHPRRDFLRLLFPQLFHKPGPQLYCRVARPPHSGP

SEQ ID NO: 761121 - protein, 248 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVMESTGVFTNPPIGAKKGWGGGGGGSFEGGAKKGVPNFPNFIISAPSADAPMFVMGVNHEKYDNNLKIISNASCTTNCLAPLAKVIHDNFGIVEGLMTTVHAITATQKTVDGPSGKLWRDGHGALQNIIPASTGTAKAMGKVIPELNGKLTGMA

SEQ ID NO: 761122 - protein, 86 aa, Homo sapiens
SSFASPAEPHRSDTMGKVKVGVNGFGRIGRLVTRAAFNSGKVDIVAINDPFIDPQRHFVKLISWYDNEFGYSNRVVDLMAHMASKE

SEQ ID NO: 761123 - protein, 232 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVMESTGVFTTMEKAGPHLQGGAKRVIISAPSADAPMFVMGVNHEKYDNNLKIISNASCTTNCLAPLAKVIHDNFGIVEGLMTTVHAITATQKTVDGPSGKLWRDGHGALQNIIPASTGTAKAMGKVIPELNGKLTGMA

SEQ ID NO: 761124 - protein, 246 aa, Homo sapiens
MGKVKVGVNGFGRIGRLVTRAAFNSGKVDIVAINDPFIDLNYMVYMFQYDSTHGKFHGTVKAENGKLVINGNPITIFQGSGKNPFQISMWAQVRGRVDIAVRRDAHMWMSYHTTRVDERLGGITLRGERRQEKIISAPSADAPMFVMGVNHEKYDNNLKIISNASCTTNCLAPLAKVIHDNFGIVEGLMTTVHAITATQKTVDGPSGKLWRDGHGALQNIIPASTGTAKAMGKVIPELNGKLTGMA

SEQ ID NO: 761125 - protein, 86 aa, Homo sapiens; identical to SEQ ID NO: 761122

SEQ ID NO: 761126 - protein, 732 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761127 - protein, 233 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDSKLCPNR

SEQ ID NO: 761128 - protein, 95 aa, Homo sapiens
KAPMLLGFESPWFPSLSAVPESPLVTGSALSCGPSPFNDLSQVMCRKPSPQDSHDTHSPPHLRVHGPLSSTPAFARYFRCARGALLNPSSRCQLW

SEQ ID NO: 761129 - protein, 530 aa, Homo sapiens
HPPCSLLLSSLSCAQIDQPEFDVPLKQDQEQKIYAQIFREYLTYLNQLGTLLGGDPSKVQEHSSLSISITSRLFQFLRPLEQRRAQGKLFQMVTIDQLKLCVPPLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761130 - protein, 423 aa, Homo sapiens
MAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761131 - protein, 293 aa, Homo sapiens
MKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761132 - protein, 177 aa, Homo sapiens
MLLGADSVCGTTHILTKAAPTLCSLAVCSLVPFSTVLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761133 - protein, 689 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRTSFNDSLTFLENAADVGGLAIALQAYSKRLLRHHGETVLPSLDLSPQQIFFRSYAGRQRPPPATACFMSVERLITEAHGSPLFRHSVKYPKPSSADVLTVIFSLPSLPLGITPQMTTGSST

SEQ ID NO: 761134 - protein, 677 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 761135 - protein, 76 aa, Homo sapiens
WGICVGLFCLHRDFLQSHMILGLVVTLSPALDSQFQEARRKLSQKLRELTEQPPMVRRGAGVFAQILERSIYSFEG

SEQ ID NO: 761136 - protein, 31 aa, Homo sapiens
ETTKLILQFLATISGQHSWIEQQVLEANPIL

SEQ ID NO: 761137 - protein, 125 aa, Homo sapiens
MSGFRLGDHVWLEPPSTHKTSVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYPHT

SEQ ID NO: 761138 - protein, 85 aa, Homo sapiens
KDMRLLGAEIKDFIIFSTAGSMNLTFLLIPFAPKCQEDDMKQSSAVNSYNSAYKLDFLIQKAGLIHPTQFPVLYLNVVDPDICLI

SEQ ID NO: 761139 - protein, 104 aa, Homo sapiens
MGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 761140 - protein, 198 aa, Homo sapiens
YTSGACSCKTKPQDRLAKEGMHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 761141 - protein, 134 aa, Homo sapiens
MVEGSLGDLTKEKMDRLLLPAPIRPGVGPEVIGAQRQPNQRHWCAWGSMVVHVGPWGGPRSQTLEAPPGSGPAAEWPAPVSHCSSLRPGPGGFIFTDMPSQSWSATPVSQRGERSRARGLFCSSHPPAPTPGQP

SEQ ID NO: 761142 - protein, 134 aa, Homo sapiens; identical to SEQ ID NO: 761141

SEQ ID NO: 761143 - protein, 134 aa, Homo sapiens; identical to SEQ ID NO: 761141

SEQ ID NO: 761144 - protein, 222 aa, Homo sapiens
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 761145 - protein, 222 aa, Homo sapiens; identical to SEQ ID NO: 761144

SEQ ID NO: 761146 - protein, 172 aa, Homo sapiens
MFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 761147 - protein, 222 aa, Homo sapiens; identical to SEQ ID NO: 761144

SEQ ID NO: 761148 - protein, 222 aa, Homo sapiens; identical to SEQ ID NO: 761144

SEQ ID NO: 761149 - protein, 207 aa, Homo sapiens
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKVTHFTVFREADPHLPSWDLVSGPWD

SEQ ID NO: 761150 - protein, 395 aa, Homo sapiens
CNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 761151 - protein, 321 aa, Homo sapiens [sequence omitted]

SEQ ID NO: 761152 - protein, 337 aa, Homo sapiens
FVPGTIVSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHT

SEQ ID NO: 761153 - protein, 370 aa, Homo sapiens
FVPGTIVSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 761154 - protein, 370 aa, Homo sapiens; identical to SEQ ID NO: 761153

SEQ ID NO: 761155 - protein, 234 aa, Homo sapiens
FVPGTIVSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDAGRRDPLN

SEQ ID NO: 761156 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 761157 - protein, 417 aa, Homo sapiens; identical to SEQ ID NO: 761156

SEQ ID NO: 761158 - protein, 417 aa, Homo sapiens; identical to SEQ ID NO: 761156

SEQ ID NO: 761159 - protein, 393 aa, Homo sapiens
MAQKEVQVSSADARLMVFDKTEGTWRLLCSSRSNARVAGLSCEEMGFLRYWGPSEGWEPGGAGEQAYTPAPPRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 761160 - protein, 429 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTSGAPSCLSPDSTHSEASGMVTQL

SEQ ID NO: 761161 - protein, 485 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRYWGPSEGWEPGGAGEQAYTPAPPRALTHSELDVRTAGANGTSGFFCVDEGRLPHTQRLLEVISVWGGGQRAGGATPQTPKALPLPVFLPPVLTGLYFLSFCVSNPISPSDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 761162 - protein, 133 aa, Homo sapiens
MALMMGRQRSGETVGRRADCAQAGGHPPPLSLVGGTGSCPDGECLPVPWPRPLPTVCSWGCRLWSTTGAIFPFGTPTARRTATILPWSTSPVPCPSQVSLRAEPWGLRTRGQEDRGGDQGHKAINLWLRHPWQ

SEQ ID NO: 761163 - protein, 417 aa, Homo sapiens; identical to SEQ ID NO: 761156

SEQ ID NO: 761164 - protein, 371 aa, Homo sapiens
MTESYFMMQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 761165 - protein, 421 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKVKVGSRWEPGWGRLGV

SEQ ID NO: 761166 - protein, 112 aa, Homo sapiens
GPSMVSVAGGRTVPCCSRPKVAALTAGTLLLLTAIGAASWAIGESGSCASDLPWPLQPPACLPSPLPSLQWLFSSGVTRSRCTQVSGAGWDPLGEPWRTRVSGGSSTSVFVE

SEQ ID NO: 761167 - protein, 114 aa, Homo sapiens
KDIISVTFKPAVQRASPVRKLTGISNIWSAQVLHKEKRSLCQLKLEKIVLKSWKNKRNLKLESNIKSFSQLRKAFLCVDRSKSNSANELIIVKTLARPFHHVPGLSGFTQRTAA

SEQ ID NO: 761168 - protein, 427 aa, Homo sapiens
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 761169 - protein, 101 aa, Homo sapiens
ILFPPIGLRVQRMHLIDYLLLLLVGLLALSHGQLHVEHDGESCSNSSHQQILETGEGSPSLKIAPANADFAFRFYYLIASETPGKNIFFSPLSISAAYAML

SEQ ID NO: 761170 - protein, 126 aa, Homo sapiens
SLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFY

SEQ ID NO: 761171 - protein, 409 aa, Homo sapiens
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 761172 - protein, 126 aa, Homo sapiens
MFSPGLVLRGLQKASRSPSDWERLPRESGRHSCRSSKGLFIKTDLFISSRHSYTECGGWFISSWHVQWRVCLGKAWEGDTGAPRGKLPPPQPKEAFQAPSVMQSCTFPHQHKPRFLEEKREAGHGG

SEQ ID NO: 761173 - protein, 147 aa, Homo sapiens
AGAGAWAGRGPAAPSGASPGRVCGVETARPLGVQRRQSADEGPPGVAGLRHEPPTVWLGSVAHRGTWVCAHRARLSVTPGKWCLVHSSRASASSLLINVCLLGVARVPHELVLKRGMHEASSRWSVRELSGFSVETQPSAAAEAHPA

SEQ ID NO: 761174 - protein, 400 aa, Homo sapiens
AGAGAWAGRGPAAPSGASPGRVCGVETARPLGVQRRQSADEGPPGVAGLRHEPPTVWLGSVAHRGTWVCAHRWFGPAVTRAAQAATMVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 761175 - protein, 388 aa, Homo sapiens
AGAGAWAGRGPAAPSGASPGRVCGVETARPLGVQRRQSADEGPPGVAGLRHEPPTVWLGSVAHRGTWVCAHRWFGPAVTRAAQAATMVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGRVPRPRVPQERALWPWATTCAQGASRDQAVPPILHPEPQSTATF

SEQ ID NO: 761176 - protein, 277 aa, Homo sapiens
AGAGAWAGRGPAAPSGASPGRVCGVETARPLGVQRRQSADEGPPGVAGLRHEPPTVWLGSVAHRGTWVCAHRWFGPAVTRAAQAATMVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLQLTRAAQAATMVKLLVAKILCMVGVFFFMLLGSLLPAGVGSSGKEAPRWVLSMDSWMASLDSLTWIRRQKGRK

SEQ ID NO: 761177 - protein, 191 aa, Homo sapiens
AGAGAWAGRGPAAPSGASPGRVCGVETARPLGVQRRQSADEGPPGVAGLRHEPPTVWLGSVAHRGTWVCAHRWFGPAVTRAAQAATMVKLLVAKILCMVGVFFFMLLGSLLPVKIIETDFEKAHRSKKILSLCNTFGGGVFLATCFNALLPAVREKVRAPWALAAALGTLWPRDSDAFSTLMPSSVKALML

SEQ ID NO: 761178 - protein, 384 aa, Homo sapiens
AVWWGRRHCGRWAFAAGAQIAERMGPATFVAGLRHEPPTVWLGSVAHRGTWVCAHRWFGPAVTRAAQAATMVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 761179 - protein, 191 aa, Homo sapiens; identical to SEQ ID NO: 761177

SEQ ID NO: 761180 - protein, 474 aa, Homo sapiens
MAQHDFVPAWLNFSTPQSAKSPTATFEKHGEHLPRGEGRFGVSRRRHNSSDGFFNNGPLRTAGDSWHQPSLFRHDSVDSGVSKGAYAGITGNPSGWHSSSRGHDGMSQRSGGGTGNHRHWNGSFHSRKGCAFQEKPPMEIREEKKEDKVEKLQFEEEDFPSLNPEAGKQHQPCRPIGTPSGVWENPPSAKQPSKMLVIKKVSKEDPAAAFSAAFTSPGSHHANGNKLSSVVPSVYKNLVPKPVPPPSKPNAWKANRMEHKSGSLSSSRESAFTSPISVTKPVVLASGAALSSPKESPSSTTPPIEISSSRLTKLTRRTTDRKSEFLKTLKDDRNGDFSENRDCDKLEDLEDNSTPEPKENGEEGCHQNGLALPVVEEGEVLSHSLEAEHRLLKAMGWQEYPENDENCLPLTEDELKEFHMKTEQLRRNGFGKNGFLQSRSSSLFSPWRSTCKAEFEDSDTETSSSETSDDDAWK

SEQ ID NO: 761181 - protein, 474 aa, Homo sapiens; identical to SEQ ID NO: 761180

SEQ ID NO: 761182 - protein, 474 aa, Homo sapiens; identical to SEQ ID NO: 761180

SEQ ID NO: 761183 - protein, 474 aa, Homo sapiens; identical to SEQ ID NO: 761180

SEQ ID NO: 761184 - protein, 474 aa, Homo sapiens; identical to SEQ ID NO: 761180

SEQ ID NO: 761185 - protein, 474 aa, Homo sapiens; identical to SEQ ID NO: 761180

SEQ ID NO: 761186 - protein, 474 aa, Homo sapiens; identical to SEQ ID NO: 761180

SEQ ID NO: 761187 - protein, 474 aa, Homo sapiens; identical to SEQ ID NO: 761180

SEQ ID NO: 761188 - protein, 280 aa, Homo sapiens [sequence omitted]

SEQ ID NO: 761189 - protein, 171 aa, Homo sapiens
MAQHDFVPAWLNFSTPQSAKSPTATFEKHGEHLPRGEGRFGVSRRRHNSSDGFFNNGPLRTAGENGLALPVVEEGEVLSHSLEAEHRLLKAMGWQEYPENDENCLPLTEDELKEFHMKTEQLRRNGFGKNGFLQSRSSSLFSPWRSTCKAEFEDSDTETSSSETSDDDAWK

SEQ ID NO: 761190 - protein, 206 aa, Homo sapiens
MAQHDFVPAWLNFSTPQSAKSPTATFEKHGEHLPRGEGRFGVSRRRHNSSDGFFNNGPLRTAGDSWHQPSLFRHDSVDSGVSKGAYAGITGNPSGWHSSSRGHDGMSQRSGGGTGNHRHWNGSFHSRKGCAFQEKPPMEIREEKKEDKVEKLQFEEEDFPSLNPEAGKQHQPCRPIGTPSGVWENPPSAKHPPDAVSFSENRARYL

SEQ ID NO: 761191 - protein, 89 aa, Homo sapiens
TGDGRAVLLVAPPPPPALPLLDLVGRAAILGRALLWLWTSRLCRVDKLGTRPQTQRLVPGHSSAAARWCLTFNSPYAGPNFACVCVDKM

SEQ ID NO: 761192 - protein, 474 aa, Homo sapiens; identical to SEQ ID NO: 761180

SEQ ID NO: 761193 - protein, 474 aa, Homo sapiens; identical to SEQ ID NO: 761180

SEQ ID NO: 761194 - protein, 474 aa, Homo sapiens; identical to SEQ ID NO: 761180

SEQ ID NO: 761195 - protein, 474 aa, Homo sapiens; identical to SEQ ID NO: 761180

SEQ ID NO: 761196 - protein, 474 aa, Homo sapiens; identical to SEQ ID NO: 761180

SEQ ID NO: 761197 - protein, 218 aa, Homo sapiens
MEHKSGSLSSSRESAFTSPISVTKPVVLASGAALSSPKESPSSTTPPIEISSSRLTKLTRRTTDRKSEFLKTLKDDRNGDFSENRDCDKLEDLEDNSTPEPKENGEEGCHQNGLALPVVEEGEVLSHSLEAEHRLLKAMGWQEYPENDENCLPLTEDELKEFHMKTEQLRRNGFGKNGFLQSRSSSLFSPWRSTCKAEFEDSDTETSSSETSDDDAWK

SEQ ID NO: 761198 - protein, 474 aa, Homo sapiens; identical to SEQ ID NO: 761180

SEQ ID NO: 761199 - protein, 441 aa, Homo sapiens
MAQHDFVPAWLNFSTPQSAKSPTATFEKHGEHLPRGEGRFGVSRRRHNSSDGFFNNGPLRTAGDSWHQPSLFRHDSVDSGVSKGAYAGITGNPSGWHSSSRGHDGMSQRSGGGTGNHRHWNGSFHSRKGCAFQEKPPMEIREEKKEDKVEKLQFEEEDFPSLNPEAGKQHQPCRPIGTPSGVWENPPSAKQPSKMLVIKKVSKEDPAAAFSAAFTSPGSHHANGNKLSSVVPSVYKNLVPKPVPPPSKPNAWKANRMEHKSGSLSSSRESAFTSPISVTKPVVLASGAALSSPKESPSSTTPPIEISSSRLTKLTRRTTDRKSEFLKTLKDDRNGDFSENRDCDKLEDLEDNSTPEPKENGEEGCHQNGLALPVVEEGEVLSHSLEAEHRLLKAMGWQEYPENDENCLPLTEDELKEFHMKTEQLRRNALERMRSRRPLLA

SEQ ID NO: 761200 - protein, 368 aa, Homo sapiens
LSACARGNRKRRLSAVPAGGGEAAVGSLGCVSPVMEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 761201 - protein, 368 aa, Homo sapiens; identical to SEQ ID NO: 761200

SEQ ID NO: 761202 - protein, 295 aa, Homo sapiens
LSACARGNRKRRLSAVPAGGGEAAVGSLGCVSPVMEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDA

SEQ ID NO: 761203 - protein, 368 aa, Homo sapiens; identical to SEQ ID NO: 761200

SEQ ID NO: 761204 - protein, 182 aa, Homo sapiens
LSACARGNRKRRLSAVPAGGGEAAVGSLGCVSPVMEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNLSFLLYKVERTSA

SEQ ID NO: 761205 - protein, 368 aa, Homo sapiens; identical to SEQ ID NO: 761200

SEQ ID NO: 761206 - protein, 285 aa, Homo sapiens
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 761207 - protein, 285 aa, Homo sapiens; identical to SEQ ID NO: 761206

SEQ ID NO: 761208 - protein, 285 aa, Homo sapiens; identical to SEQ ID NO: 761206

SEQ ID NO: 761209 - protein, 285 aa, Homo sapiens; identical to SEQ ID NO: 761206

SEQ ID NO: 761210 - protein, 312 aa, Homo sapiens
LGWVRGWVFNSAEGGRSGGGDDGRDVGMAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 761211 - protein, 245 aa, Homo sapiens
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPPPPVPAGRLATPFTAAMSSGQAVPYPGLQCPPLPPRVGLPTQQGFSSQFVSPYPPPLPQRPPPRLPPHQPGFILQ

SEQ ID NO: 761212 - protein, 285 aa, Homo sapiens; identical to SEQ ID NO: 761206

SEQ ID NO: 761213 - protein, 285 aa, Homo sapiens; identical to SEQ ID NO: 761206

SEQ ID NO: 761214 - protein, 290 aa, Homo sapiens
RETFILTARSSGGEVVMAAPEAEVLSSAAVPDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPRVLILLGGNALSPKEFYELDLSLLAPYSVDQSLSTAACLRRLFRAIFMADAFSELQAPPLMGTVVMAQGHRNCGEDWFRPKLNYRVPSRGHKLTVTLSCGRPSIRTTAWEDYIWFQAPVTFKGFRE

SEQ ID NO: 761215 - protein, 306 aa, Homo sapiens
MARVPLGRSLTLSPRLEHNGMTSAHHNFRLPGSRDSPASASQVAEIIDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPRVLILLGGNALSPKEFYELDLSLLAPYSVDQSLSTAACLRRLFRAIFMADAFSELQAPPLMGTVVMAQGHRNCGEDWFRPKLNYRVPSRGHKLTVTLSCGRPSIRTTAWEDYIWFQAPVTFKGFRE

SEQ ID NO: 761216 - protein, 355 aa, Homo sapiens
MDFIFHEKQEGFLCAQHCLNNLLQGEYFSPVELASIAHQLDEEERMRMAEGGVTSEEYLAFLQQPSENMDDTGFFSIQVISNALKFWGLEIIHFNNPEYQKLGIDPINERSFICNYKQHWFTIRKFGKHWFNLNSLLAGPELISDTCLANFLARLQQQAYSVFVVKGDLPDCEADQLLQIISVEEMDTPKLNGKKLVKQKEHRVYKTVLEKVSEESDESGTSDQDEEDFQRALELSRQETNREDEHLRSTIELSMQGSSGNTSQDLPKTSCVTPASEQPKKIKEDYFEKHQQEQKQQQQQSDLPGHSSYLHERPTTSSRAIESDLSDDISEGTVQAAVDTILEIMRKNLKIKGEK

SEQ ID NO: 761217 - protein, 342 aa, Homo sapiens
SSSVIAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 761218 - protein, 211 aa, Homo sapiens
MWASLSLDHPSAKENQALRLIEMREENGNVPKTEQAGSLKPLRDTGKSNLKEKKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 761219 - protein, 170 aa, Homo sapiens
DSSEILRRQDTGKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 761220 - protein, 342 aa, Homo sapiens; identical to SEQ ID NO: 761217

SEQ ID NO: 761221 - protein, 180 aa, Homo sapiens
GLIGLTWSKSLTQGFATGRGNLCPGQDWIMEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQS

SEQ ID NO: 761222 - protein, 72 aa, Homo sapiens
GLIGLTWSKSLTQGFATGRGNLCPGQDWIMEVGSEEEKWEKLDAEFDHFVVDMKPFVLKLPHRTDNLHTTRI

SEQ ID NO: 761223 - protein, 369 aa, Homo sapiens
SGSMATENAVFFYKVFVKMIFEFLLYCERRMEWGLAFSMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 761224 - protein, 153 aa, Homo sapiens
SGSMATENAVFFYKVFVKMIFEFLLYCERRMEWGLAFSMEKVEADLTRSKSLREKQSKEFLWQLEDIRQRYEQQVLEKCFEVLNGKITTGDSACFQPCFIYQLANHSCVSSLLLSLYHELRELQQAVVLAVDGWLERKRNKEAVYAGRPWYHL

SEQ ID NO: 761225 - protein, 146 aa, Homo sapiens
SWLEGAGQSRGEGDPTGSMDGAYRPRHKPGSAQGQVWAVWRQRLESSVLHEAPLFAVLAGRPGSMFCGSAWLQRLPGSESLKPRAEPGLSALVRERGYGPHHHLGQWMGHSEAGLAHTVLVGSLTPTLFPPPPRACFFKSNRFTEM

SEQ ID NO: 761226 - protein, 243 aa, Homo sapiens
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEVMPPSSFLFDAPCSFLSFQMLSQSWSYTKNNSYVLSTGFMPGIMPSTLYLSCRI

SEQ ID NO: 761227 - protein, 218 aa, Homo sapiens
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 761228 - protein, 218 aa, Homo sapiens; identical to SEQ ID NO: 761227

SEQ ID NO: 761229 - protein, 859 aa, Homo sapiens
MRELTCTSQPPIIPSIEEPVVSCDGWGATVAPEASGKGRNPPVALGPRGNSLLDAVPWHPQTPYVVISGPQVSQVASHTPPPMPSGKWRSCGNRPRSVADISRGTQAPRSLVGETRPHRGSTHPDSLAPRRYPNAFLIKASSLLRPGPATRSKTTDPSAPVLPSWAHGHPDIPEQARSSCICCLLCSPGWQTLLLLREALARGPLPTFSGAGPHPDGKLFCLALLPHCTERTRCGGRGGHRHSQPHLAQGRCMSTCQMTDGHFDLGLDVAGAPSQMWPQSQAWGLCGSGLPGRPQEDMGSWSSGLAERPDVLPMQAASVPWLPTHQRPAHAHQGLAWPDVQYGFGRGHPALARPMDCHSPPHPTSRTRSSSATPGGWFRKAGFSKLHTRGCTELKSGESQGSQGGPLPHTLRQTRRRHPRHPAASASAPAEGGAGVGCREYGPQAAAMGLPELSGFQQTRRPLRPAWTGCVPRIHMLKPSLQCDGVGEGAFGGDWVRRVEPSEEDQHPQGKRHGRWVPFSASCHVGTWEGIVCKPGSRPSQNRVCPLLDLDLWLPELLRNKFLLFEGTKSKLLCCSCPSETEPHATQTSGESQPPPHGRVGMGARQREPYSERASGGGQEGAQVSQFPGLDTPLFPGLTQEGAQVSPVPGSDTPLFPGLSREGAQVSPVPGSDTPLFPGLAREVAQVSPVPGSDTPLFPGLAREVAQVSPVPGSDTPLFPGLVREVAQVSPVPGSDTPLFPGFSQILPLVEFEESMMCPSLRLGRAGPILETSLLLNHTSWHPTYRDEIHLGQLLSPRGFVPKGASRESGDSFGRHSRGADGMASSGWRPGGWGGTKHPAGHRAAPTEHSVIQPQCQSC

SEQ ID NO: 761230 - protein, 771 aa, Homo sapiens [sequence omitted]

SEQ ID NO: 761231 - protein, 510 aa, Homo sapiens
FHPLPSTPLFRHLLTSVMTCGFNSIGCGFRPGNFSCVSACGPRPSRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNCECCQSNLEPLFAGYIETLRREAECVEADSGRLASELNHVQEVLEGYKKKYEEEVALRATAENEFVALKKDVDCAYLRKSDLEANVEALIQEIDFLRRLYEEEIRILQSHISDTSVVVKLDNSRDLNMDCIVAEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVEAVNVCVSSSRGGVVCGDLCVSGSRPVTGSVCSAPCNGNLVVSTGLCKPCGQLNTTCGGGSCGQGRY

SEQ ID NO: 761232 - protein, 711 aa, Homo sapiens
MAERESGGLGGGAASPPAASPFLGLHIASPPNFRLTHDISLEEFEDEDLSEITDECGISLQCKDTLSLRPPRAGLLSAGGGGAGSRLQAEMLQMDLIDATGDTPGAEDDEEDDDEERAARRPGAGPPKAESGQEPASRGQGQSQGQSQGPGSGDTYRPKRPTTLNLFPQVPRSQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761233 - protein, 711 aa, Homo sapiens; identical to SEQ ID NO: 761232

SEQ ID NO: 761234 - protein, 701 aa, Homo sapiens
MQLVLKMDSSPDNDSWLEDQWERWLTHDISLEEFEDEDLSEITDECGISLQCKDTLSLRPPRAGLLSAGGGGAGSRLQAEMLQMDLIDATGDTPGAEDDEEDDDEERAARRPGAGPPKAESGQEPASRGQGQSQGQSQGPGSGDTYRPKRPTTLNLFPQVPRSQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761235 - protein, 470 aa, Homo sapiens
AADEPDVHFSKKFLNPTSIFSKKFRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761236 - protein, 259 aa, Homo sapiens
PGGEFGTRGQGSGAMGRGKSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761237 - protein, 37 aa, Homo sapiens
CSAPSCSFCPSSIHACFPALAKNSDWVDQFRVKFLGS

SEQ ID NO: 761238 - protein, 711 aa, Homo sapiens; identical to SEQ ID NO: 761232

SEQ ID NO: 761239 - protein, 711 aa, Homo sapiens; identical to SEQ ID NO: 761232

SEQ ID NO: 761240 - protein, 552 aa, Homo sapiens
TVDHFHHKSLLFPAQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761241 - protein, 303 aa, Homo sapiens
MMVAEIGWEWQLWEPPCGRGLVPYKAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 761242 - protein, 81 aa, Homo sapiens
MLLQMFTEITMLLWLPDPRVGLAGQALVPNFSPVLAGDRFVPRHEDELELEVDDPLLVELQAEDYWYEAYNMRTGARGVFP

SEQ ID NO: 761243 - protein, 159 aa, Homo sapiens
LSPHWEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 761244 - protein, 159 aa, Homo sapiens; identical to SEQ ID NO: 761243

SEQ ID NO: 761245 - protein, 95 aa, Homo sapiens
LSPHWEEEEEEGEAAGENIGEKSESREEKLGDSLQDLYRALEQASLSPLGEHRISTKMEYKLSFIKRCNDPVMNEKLHRLRILKSTLKVRQEMEG

SEQ ID NO: 761246 - protein, 159 aa, Homo sapiens; identical to SEQ ID NO: 761243

SEQ ID NO: 761247 - protein, 207 aa, Homo sapiens
KVQCYPSSTSPAASSGFPMALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSFSFSTNLQKRLRRKD

SEQ ID NO: 761248 - protein, 272 aa, Homo sapiens
GSGPGPAPTLGLHSGMEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLAGVLSFSSRVCTDIFKPPVATAVAPYVSWIRKVTGRSA

SEQ ID NO: 761249 - protein, 187 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761250 - protein, 217 aa, Homo sapiens
IRLGTRPGGALVGLERRVRKSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761251 - protein, 187 aa, Homo sapiens; identical to SEQ ID NO: 761249

SEQ ID NO: 761252 - protein, 187 aa, Homo sapiens; identical to SEQ ID NO: 761249

SEQ ID NO: 761253 - protein, 187 aa, Homo sapiens; identical to SEQ ID NO: 761249

SEQ ID NO: 761254 - protein, 187 aa, Homo sapiens; identical to SEQ ID NO: 761249

SEQ ID NO: 761255 - protein, 240 aa, Homo sapiens
VTREAPQLLSQRQRREVRGVWGWGCLPGPRGGPALFGLVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761256 - protein, 187 aa, Homo sapiens; identical to SEQ ID NO: 761249

SEQ ID NO: 761257 - protein, 187 aa, Homo sapiens; identical to SEQ ID NO: 761249

SEQ ID NO: 761258 - protein, 209 aa, Homo sapiens
CGCSRGSQAEWKSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761259 - protein, 200 aa, Homo sapiens
LTQVLIRVAGLWVMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761260 - protein, 174 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKT

SEQ ID NO: 761261 - protein, 187 aa, Homo sapiens; identical to SEQ ID NO: 761249

SEQ ID NO: 761262 - protein, 124 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTVLFAHITGGVFCDNEKHQKSFCTLWFPLF

SEQ ID NO: 761263 - protein, 119 aa, Homo sapiens
MRSGTSQRAPTSGVRFPTRLHSPSGPELFGRATRPFLPHCCLVCAQFLWDWAVSFPLERSSVVPLLTQPQISTVRPYKENGEPLLVDALLPLSCPCWSGKHTFLLCLHKSNVFPFPPLA

SEQ ID NO: 761264 - protein, 209 aa, Homo sapiens; identical to SEQ ID NO: 761258

SEQ ID NO: 761265 - protein, 173 aa, Homo sapiens
VTREAPQLLSQRQRREVRGVWGWGCLPGPRGGPALFGLVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTARGGWPPGGLFSEPRPSPSGTEIFY

SEQ ID NO: 761266 - protein, 187 aa, Homo sapiens; identical to SEQ ID NO: 761249

SEQ ID NO: 761267 - protein, 187 aa, Homo sapiens; identical to SEQ ID NO: 761249

SEQ ID NO: 761268 - protein, 187 aa, Homo sapiens; identical to SEQ ID NO: 761249

SEQ ID NO: 761269 - protein, 187 aa, Homo sapiens; identical to SEQ ID NO: 761249

SEQ ID NO: 761270 - protein, 217 aa, Homo sapiens; identical to SEQ ID NO: 761250

SEQ ID NO: 761271 - protein, 187 aa, Homo sapiens; identical to SEQ ID NO: 761249

SEQ ID NO: 761272 - protein, 177 aa, Homo sapiens
IRLGTRPGGTPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGIHLAFPGKPVCGTGGHVWLRPF

SEQ ID NO: 761273 - protein, 131 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSSPSVHSMPGAVATSFWEVS

SEQ ID NO: 761274 - protein, 109 aa, Homo sapiens
MNIFDRKINFDALLKFSHITPSTQQHLKKVYASFALCMFVAAAGAYVHMVTHFIQAGLLSALGSLILMIWLMATPHSHETEQELAWALPWSFVLLSTPASFPLLSWARQ

SEQ ID NO: 761275 - protein, 150 aa, Homo sapiens
MGPPCCRHRYFLPAPDGSLGLCFGAGQAGVTALRPSSLPPAPPALPEPPPLSFLPLEFLRTGLCPKWSPHAVLRETWALGKQVLGTKVDAERDGVKVPTTLAEYCVKTKAPAPDEGSDLFYDDYYEDGEVEEEADSCFGDDEDDSGTEES

SEQ ID NO: 761276 - protein, 87 aa, Homo sapiens
GARSVYFEKIRALGVPGRRRRRRGGGRRRPRWLPPGPPVPSGGELSPTSTGVPQLPDWPHPGGATGALLGTWAGGRFLTLPAWEAQV

SEQ ID NO: 761277 - protein, 163 aa, Homo sapiens
VGVLTKECGTTNSDETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 761278 - protein, 136 aa, Homo sapiens
REEPEGWGAPGRPTPTHSPHRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 761279 - protein, 158 aa, Homo sapiens
GGARGPGQGKRRWGGGARAAGALGVPGRRRRRRGGGRRRPRWLPPGRCAARPVSRTRGGRAAPRCSDPGPLRRRHGSAASAQLAEGAAAGAQGAAGRAGRGIPRDTGGRGRSIQLGGGHLRAPQHLLRGRLLQGAPQVPHRLPILSTSLSVPDQDVAP

SEQ ID NO: 761280 - protein, 310 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 761281 - protein, 295 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRTQEHPGHLPSCTRWYLVSWGHLGAASWCWAVSASLARFFPATSLRHHLLEIPAQK

SEQ ID NO: 761282 - protein, 250 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKETGALLGTWAGGRFLTLPAWEAQV

SEQ ID NO: 761283 - protein, 237 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDAERDGVKVPTTLAEYCVKTKAPAPDEGSDLFYDDYYEDGEVEEEADSCFGDDEDDSGTEES

SEQ ID NO: 761284 - protein, 310 aa, Homo sapiens; identical to SEQ ID NO: 761280

SEQ ID NO: 761285 - protein, 310 aa, Homo sapiens; identical to SEQ ID NO: 761280

SEQ ID NO: 761286 - protein, 178 aa, Homo sapiens
MGPPCCRHRYFLPAPDGSLGLCFGAGQAGVTALRPSSLHPHLLPSRAPSSVISPPGVPHAQGFVLSGRTRRFKRNLSVGVSVGPGGGGPGRGRVQARGWRPHPPCPPRKQVLGTKVDAERDGVKVPTTLAEYCVKTKAPAPDEGSDLFYDDYYEDGEVEEEADSCFGDDEDDSGTEES

SEQ ID NO: 761287 - protein, 310 aa, Homo sapiens; identical to SEQ ID NO: 761280

SEQ ID NO: 761288 - protein, 343 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRTQEHPGHLPSCTRWYLVSWGHLGAASWCWAVSALSSHGGRAPCGLLGSGLQAPAGLWRSQGSCPGRPSGADVLGGPGPVVSPGPGGWLLGPVLPGHLPEAPPP

SEQ ID NO: 761289 - protein, 195 aa, Homo sapiens
AGRAGPAKASAGGAAAPELLERSGSPGGGGGAEEEAGGGPGGSPPDGARPGPSRELAVVARPRAAPTPGPSAAAMARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVR

SEQ ID NO: 761290 - protein, 164 aa, Homo sapiens
TAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHV

SEQ ID NO: 761291 - protein, 364 aa, Homo sapiens
SVTCPIMFRALPLRIIPRTSPRGLCSSRAREGQAVGGGWNETMSASSWPQNGMPPSSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 761292 - protein, 364 aa, Homo sapiens; identical to SEQ ID NO: 761291

SEQ ID NO: 761293 - protein, 327 aa, Homo sapiens
MGGSALNQGVLEGDDAPGQSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 761294 - protein, 324 aa, Homo sapiens
SVTCPIMFRALPLRIIPRTSPRGLCSSRAREGQAVGGGWNETMSASSWPQNGMPPSSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 761295 - protein, 202 aa, Homo sapiens
MGTIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSASPNSHPPLPS

SEQ ID NO: 761296 - protein, 716 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761297 - protein, 748 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761298 - protein, 777 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRWGLSFMGIVEAGDPGGALNPEDAGPLERLMGFVLGTQALQCLPSWGQGWASLVGNDCGPHRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761299 - protein, 537 aa, Homo sapiens [sequence omitted]

SEQ ID NO: 761300 - protein, 548 aa, Homo sapiens
MGFVLGTQALQCLPSWGQGWASLVGNDCGPHRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761301 - protein, 678 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSHGAPRSPSGPRPGLSAPGTDRQQTVLPHGHGKPQ

SEQ ID NO: 761302 - protein, 349 aa, Homo sapiens
MTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761303 - protein, 78 aa, Homo sapiens
HASRTRGAKSRCANCSQGAARVGCTYRLALQPPNLPLAPVRFLCPLIPAQDFPGPLLSLGPDLLVLPLTPLCNPHFGS

SEQ ID NO: 761304 - protein, 748 aa, Homo sapiens; identical to SEQ ID NO: 761297

SEQ ID NO: 761305 - protein, 529 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPGWSPNPGVAGELAAKSQQEASEGSVCLQYPGTGPHLSAAIYVHCPCFPGALKGAMNVELNPSLMEPQRGSLDRHS

SEQ ID NO: 761306 - protein, 426 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTKRRPKARRSSR

SEQ ID NO: 761307 - protein, 423 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPNTVRWRWANAPCWPTHRVGPTHRGVGVKEADSVDER

SEQ ID NO: 761308 - protein, 393 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPTRPQLRSLI

SEQ ID NO: 761309 - protein, 716 aa, Homo sapiens; identical to SEQ ID NO: 761296

SEQ ID NO: 761310 - protein, 716 aa, Homo sapiens; identical to SEQ ID NO: 761296

SEQ ID NO: 761311 - protein, 716 aa, Homo sapiens; identical to SEQ ID NO: 761296

SEQ ID NO: 761312 - protein, 548 aa, Homo sapiens; identical to SEQ ID NO: 761300

SEQ ID NO: 761313 - protein, 553 aa, Homo sapiens
QRIPWLIRGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761314 - protein, 316 aa, Homo sapiens
LTGNHLPFHFQFSGESLKLKLLLFTDARIVVAVVSGTIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 761315 - protein, 526 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTEPGCVPLSIRPSFLLCLVPEREIKGTKSRCANCSQGAARVGCTYRLALQPPNLPLAPVRFLCPLIPAQDFPGPLLSLGPDLLVLPLTPLCNPHFGS

SEQ ID NO: 761316 - protein, 90 aa, Homo sapiens
KLRYAPRVGQLLPIIVALQAREFTSDCELEIAPRVAACGGGRGASLALFIFLSHSCMHTCTEMHTQVPMQVHLSLRAGPCPKGWTLLILS

SEQ ID NO: 761317 - protein, 422 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTIEPVSPS

SEQ ID NO: 761318 - protein, 416 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRNRSPFPGHLTPWGPGGFPQLGPVNREPFPLDYRDG

SEQ ID NO: 761319 - protein, 390 aa, Homo sapiens
AESGERKPPPSGRLGPAARAGRARAAGPEARAMGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGYGWNGALGKGLGLAYTHPAFTRTPLFSGPSP

SEQ ID NO: 761320 - protein, 2266 aa, Homo sapiens
RLAASPSFSWAGAMRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 761321 - protein, 144 aa, Homo sapiens
TSLSVEETALEPMDTAYPREDTRAPTPSKAGAHTALTLGAPHPPPRDHLIWSVFSTLYLNLCCLGFLALAYSIKARDQKVVGDLEAARRFGSKAKCYNILAAMWTLVPPLLLLGLVVTGALHLARLAKDSAAFFSTKFDDADYD

SEQ ID NO: 761322 - protein, 115 aa, Homo sapiens
RNSVPRANSCLVQWGGAGIVQFSDLSSPGPTSSSFHSPRPPGSHLRVQSGSSLAPGPSLFSSSLAPVTLSLSLPLNLPKGTFPFSWHLVIDSQGKVSSADVYEGHSAEINCAEDE

SEQ ID NO: 761323 - protein, 104 aa, Homo sapiens
TDMVHSVVTFQEPVVGCPVSVGGKQVKHNLLFAFHPSVHHEIISRLSDCCPPGAGREGVLRELLVILHACGLGDHILFLSDGICWTRKKNHWELCSSNFGFRSL

SEQ ID NO: 761324 - protein, 110 aa, Homo sapiens
MTYPPHRAFSRSDVPYPLLSSPVQWPLSLVVGDTSTRWPQQPSALESDCPGPSHPCLAGLLGPMHPVDIPLSTALHSKHQRRLTQCVLMVQSPSKQRSLYLLNKKIPHDA

SEQ ID NO: 761325 - protein, 110 aa, Homo sapiens; identical to SEQ ID NO: 761324

SEQ ID NO: 761326 - protein, 486 aa, Homo sapiens
IQHHLQKLEGRRLDFDKKKRQGKIPDEELRQALEKFEDSKEVAETSMHNLLETNIEQVSQLRALAEAQLNYHWQAMQILDELAEKLKRRMREASSRPKREYKPKFWEPFDLGEPEQSNGGFPCTTVPKIAASSPFRSSDKSIWTPSRSMPPLDQPSCKVLYDFQPENHGELGFHEGDVFTLINQINENWYQGMLDSQLGFFLLSYMDVLMPLPSDSLVPPPRPSIHTGWHPRQVSCLPWAPAAKAVSKPAGATQARALEVLPQQGATLGWEAYLVSGWGRLFKLALTPNGDGSLPHSMAPASSLLPNSSPSWPRRGNTKVLSETLMFLQGSPHLRPDPWGPSPQPTLEFHGLNRLGSSVPVGWLRDRTLVLNPSTSLLLAMNPSPTPGPQYPSLTHALLLPKARAEGLTVSLACCQLATRRQRPAGICPTFPPILLPSTLRTENMASSRALPPKPYPQHTKYLFSFLTAPSQAHGSLCHSGTSCHH

SEQ ID NO: 761327 - protein, 155 aa, Homo sapiens
RVKVSSLPYSVDALVSDKKPPKEASPVPAKSASSGATLRLLLLPGHGAREAHSPGPLIKPFETASVKWENSLRRSGVDAGTLLIIRRRQDTLSPTTCTLRKHKTNPKPRTAFTTSQLLALEGKLLQKQYLSIAEGADFSSSPNLTETQVKILFQN

SEQ ID NO: 761328 - protein, 1457 aa, Homo sapiens
TESRDPGRAVNVWSLRFLCLRRASLARRRKSVWQPGYPLLPAPADAPAAAGRRPGSLALCAQLSCAAGCREFHLRASFSRQALGERTGSRVLGISPGSRCRMQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 761329 - protein, 112 aa, Homo sapiens
YIRKVVVVQSDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 761330 - protein, 1457 aa, Homo sapiens; identical to SEQ ID NO: 761328

SEQ ID NO: 761331 - protein, 560 aa, Homo sapiens
MLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWGFYFLLLAVQAMITVIIVFAMIKIGQLFRKLIRERALG

SEQ ID NO: 761332 - protein, 584 aa, Homo sapiens
GSQGSVQARTLLCVDHTPTVAFSDMLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWGFYFLLLAVQAMITVIIVFAMIKIGQLFRKLIRERALG

SEQ ID NO: 761333 - protein, 110 aa, Homo sapiens
WSHSLMLRIAPPSPCGGQCGDPKSQWGKEFLIEKAVISPGFDVFAKKNQGILEFYGDDIALLKLAQKVKMSTHARPICLPCTMEANLALRRPQGSTCRDHGRLEWEQTEH

SEQ ID NO: 761334 - protein, 752 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761335 - protein, 620 aa, Homo sapiens
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761336 - protein, 690 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761337 - protein, 410 aa, Homo sapiens
MPTIKLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761338 - protein, 633 aa, Homo sapiens
LLMVLILKGNLKGSVFCCWFCGGQVTKQAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761339 - protein, 661 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761340 - protein, 531 aa, Homo sapiens
CLSLPRSWDYRHAPPCLAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 761341 - protein, 752 aa, Homo sapiens; identical to SEQ ID NO: 761334

SEQ ID NO: 761342 - protein, 538 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCSAMATTTPCGGSMWETPNPSGAKNSLLRRR

SEQ ID NO: 761343 - protein, 538 aa, Homo sapiens; identical to SEQ ID NO: 761342

SEQ ID NO: 761344 - protein, 424 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGGQAGGKSCWEKD

SEQ ID NO: 761345 - protein, 470 aa, Homo sapiens
MMLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSWRYKVSVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 761346 - protein, 189 aa, Homo sapiens
MMLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSVKPCLGPVLWVGVREGQGGTTWHGEAAWGPVGM

SEQ ID NO: 761347 - protein, 129 aa, Homo sapiens
IIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEV

SEQ ID NO: 761348 - protein, 299 aa, Homo sapiens
IIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 761349 - protein, 299 aa, Homo sapiens; identical to SEQ ID NO: 761348

SEQ ID NO: 761350 - protein, 299 aa, Homo sapiens; identical to SEQ ID NO: 761348

SEQ ID NO: 761351 - protein, 299 aa, Homo sapiens; identical to SEQ ID NO: 761348

SEQ ID NO: 761352 - protein, 312 aa, Homo sapiens
MPEETQTQDQPMEEEEVETFAFQAEIAQLMSLIINTFYSNKEIFLRELISNSSDALDKIWYESLTDPSKLDSGKELHINLIPNKQDQTLTIVDTGIGMTKADLINNLGTIAKSGTKAFMEALQAGADISMIGQFGVSFYSAYLVAEKVTVITKHNDDEQYAWESSAGGSFTVRTDTGERMGRGTKVILHLKEDQTEYLEEQRIKEIVKKHSQLIGYPITLFVEKECDKEVSDDETEEKEDKEEEKEKEEKESKDKPEIEDVGSDEEEEKKDGDKKKKKKTKEKYIDQEELNKTKPIWTRNPDDITNEEYGEF

SEQ ID NO: 761353 - protein, 1031 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPLSQGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 761354 - protein, 1053 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 761355 - protein, 512 aa, Homo sapiens
MERARKFSGSGLAMGLGSASASAWRRASQRWAWPLRSLRPGGDAREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 761356 - protein, 923 aa, Homo sapiens
HPFSASAPASSLPLGLGPEATTGDTEPPVLEGEPWVRGSVGAEAPGRPPGPRPRSARAPPRVPPPSWSEQCECAREPGGGGGGGGGGGGGVESGVGWGVRAAGGSAMHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEIVLERGNSGLGFSIAGGIDNPHVPDDPGIFITKIIPGGAAAMDGRLGVNDCVLRVNEVEVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 761357 - protein, 923 aa, Homo sapiens; identical to SEQ ID NO: 761356

SEQ ID NO: 761358 - protein, 923 aa, Homo sapiens; identical to SEQ ID NO: 761356

SEQ ID NO: 761359 - protein, 402 aa, Homo sapiens
TEGLAGAGAFSALDLDSDPAPEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 761360 - protein, 119 aa, Homo sapiens [sequence omitted]

SEQ ID NO: 761361 - protein, 923 aa, Homo sapiens; identical to SEQ ID NO: 761356

SEQ ID NO: 761362 - protein, 923 aa, Homo sapiens; identical to SEQ ID NO: 761356

SEQ ID NO: 761363 - protein, 968 aa, Homo sapiens
HPFSASAPASSLPLGLGPEATTGDTEPPVLEGEPWVRGSVGAEAPGRPPGPRPRSARAPPRVPPPSWSEQCECAREPGGGGGGGGGGGGGVESGVGWGVRAAGGSAMHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEIVLERGNSGLGFSIAGGIDNPHVPDDPGIFITKIIPGGAAAMDGRLGVNDCVLRVNEVEVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIETAAFPGQYNGLKAKRDKVTADCDSGEEG

SEQ ID NO: 761364 - protein, 712 aa, Homo sapiens
HPFSASAPASSLPLGLGPEATTGDTEPPVLEGEPWVRGSVGAEAPGRPPGPRPRSARAPPRVPPPSWSEQCECAREPGGGGGGGGGGGGGVESGVGWGVRAAGGSAMHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEIVLERGNSGLGFSIAGGIDNPHVPDDPGIFITKIIPGGAAAMDGRLGVNDCVLRVNEVEVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRVSGDPQGNQPVGKEG

SEQ ID NO: 761365 - protein, 493 aa, Homo sapiens
GDSPGPLHWESRMGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 761366 - protein, 282 aa, Homo sapiens
MIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 761367 - protein, 368 aa, Homo sapiens
GDSPGPLHWESRMGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRVRSPLVPHECRPSLLDSRGFSLKPLHLSA

SEQ ID NO: 761368 - protein, 258 aa, Homo sapiens
LARDIFSKSEENQVYVELCRRQPLVSAFRFGVRERSALPAAVLNSGARVWPSASALGLAAPPKDAEDRARPASGLRGARVLSEGREPGASLRVQVRPGLDVAAPGVCSLSCPSPPRSSAHPGPRGPLFPALLAALARPHGAEVPGRRARARAGTGFRFFPGPDPRPRTRPPAHARGAHAHRGGSAWKRSPTSSPSCSEGNGESAGNDPNCQPAPLQPALALLKTSSSHQSLASPYPESPAQFNISSENLPVRKENIHK

SEQ ID NO: 761369 - protein, 258 aa, Homo sapiens; identical to SEQ ID NO: 761368

SEQ ID NO: 761370 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 761371 - protein, 358 aa, Homo sapiens; identical to SEQ ID NO: 761370

SEQ ID NO: 761372 - protein, 578 aa, Homo sapiens
RKEFEPLPQPDHLCWLLGQAPRQIQFETQTLGPRRRWWARRKVPLPVAMGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGFCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 761373 - protein, 519 aa, Homo sapiens
RKEFEPLPQPDHLCWLLGQAPRQIQFETQTLGPRRRWWARRKVPLPVAMGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGFCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 761374 - protein, 100 aa, Homo sapiens
VTPVLLSVGLPSSLYSIVWFLSPILGFLLQPVVGSASDHCRSRWGRRRPYILTLGVMMLVGMALYLNGATVVAGKWAAQGGQTGICVLVCTSAGGGCSCV

SEQ ID NO: 761375 - protein, 291 aa, Homo sapiens
RKEFEPLPQPDHLCWLLGQAPRQIQFETQTLGPRRRWWARRKVPLPVAMGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTDSQGNDIKVTAESTGEHASSLPLPLHQPPHWMDGLPVQHAVLHRFHGPDCVPRGSL

SEQ ID NO: 761376 - protein, 127 aa, Homo sapiens
MSINIYWKANSAPHCPCFCTTAAELSSYDQGCIIHEAKGIYYLAGHRKILLTCALNDSSLRSNGGSVLPLQRQQAPGGDPDNSVRGKGMDCATLTCMVQLAQILVGGGLGFLVNTAGTVVVVVITAS

SEQ ID NO: 761377 - protein, 101 aa, Homo sapiens
ICHPLRYTIIMSHRACIILAMGTSFFGCIQATFLTTLTFQLPYCVPNEVDYYFCDIPVMLKLACADTSALEMVGFISVGLMPLSCFLLILTSYSGIVFSIL

SEQ ID NO: 761378 - protein, 100 aa, Homo sapiens
AEAPAVTCAAFFRWNQKVPEPEPGVQVFSVAFGICSPSQNSQDRRYRREMESRILKTYEKYGSDHLDRASHPPLEPRRLLGVAALPRVRMRRSATTGPLA

SEQ ID NO: 761379 - protein, 643 aa, Homo sapiens
PSRDCASPPRSGLPERAFGPRTPRAPRRRRRRLLLSPPPRPPPPLDREPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761380 - protein, 643 aa, Homo sapiens; identical to SEQ ID NO: 761379

SEQ ID NO: 761381 - protein, 594 aa, Homo sapiens
AAAALPGVAAARVSRAPGGPQPALVPRWLFASCEPFRPAPLRRLSPARAPAPRARAPPGAAGAAAAKGVPRPPPRWKPGPSPSPSHWPFPTGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761382 - protein, 518 aa, Homo sapiens
CHLGSSAGTCHPLPHGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761383 - protein, 624 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKDPAVSLQVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761384 - protein, 310 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761385 - protein, 592 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSELS

SEQ ID NO: 761386 - protein, 526 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQSCPEPTDPEEAA

SEQ ID NO: 761387 - protein, 561 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASEGRAWPGGQGARVGGGATGV

SEQ ID NO: 761388 - protein, 617 aa, Homo sapiens
PSRDCASPPRSGLPERAFGPRTPRAPGPWLCPSRAGTAQDPARIRERRGRVAGGAAGPAMELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761389 - protein, 508 aa, Homo sapiens
MHDLKGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCGRKVSRKSSSSRTPLTHALPGLSEQEGQKTSAASCPQPPTFLLPLLLFLALTVARPRWR

SEQ ID NO: 761390 - protein, 617 aa, Homo sapiens; identical to SEQ ID NO: 761388

SEQ ID NO: 761391 - protein, 617 aa, Homo sapiens; identical to SEQ ID NO: 761388

SEQ ID NO: 761392 - protein, 210 aa, Homo sapiens [sequence omitted]

SEQ ID NO: 761393 - protein, 617 aa, Homo sapiens; identical to SEQ ID NO: 761388

SEQ ID NO: 761394 - protein, 152 aa, Homo sapiens
MEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKCAKCGPA

SEQ ID NO: 761395 - protein, 612 aa, Homo sapiens
MEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 761396 - protein, 612 aa, Homo sapiens; identical to SEQ ID NO: 761395

SEQ ID NO: 761397 - protein, 172 aa, Homo sapiens
SCFPQGGPRILASCRHEAKILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 761398 - protein, 612 aa, Homo sapiens; identical to SEQ ID NO: 761395

SEQ ID NO: 761399 - protein, 612 aa, Homo sapiens; identical to SEQ ID NO: 761395

SEQ ID NO: 761400 - protein, 659 aa, Homo sapiens
NTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 761401 - protein, 296 aa, Homo sapiens
RPQLASNPCCPWALQVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 761402 - protein, 612 aa, Homo sapiens; identical to SEQ ID NO: 761395

SEQ ID NO: 761403 - protein, 225 aa, Homo sapiens
MEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALEVA

SEQ ID NO: 761404 - protein, 200 aa, Homo sapiens
PGTSGGALQARGTPMAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTGGPLHCCWHLLAPLRLSGHGQAAFASGCGMVEPFFEGVCFRVGGLAMVMIKIGCCHFQNERQGRKVQCTWKSPRMRPPAGTSTSMVV

SEQ ID NO: 761405 - protein, 322 aa, Homo sapiens
QALPAARCRRGEHQWRGELGAAAARADSGSGWGSARSPSSVLASGLGAERWAPSPHSASATGARPGFRVAVPREEGALRYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761406 - protein, 162 aa, Homo sapiens
MLAPWICTSASLLVCDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761407 - protein, 159 aa, Homo sapiens
ARHFRRRAAGAGNTNGGRQGFHTVGSRCKNRTGAEHLWLTRHLRDPFVKAAKVESYRCRSAFKLLEVNERHQILRPGLRVLDCGAAPGAWSQVAVQKVNAAGTDGVSLLPRLQCNGVISAHCNLCLPGSSDSPASASQVAGITGARHRTQLIFSFCFFK

SEQ ID NO: 761408 - protein, 250 aa, Homo sapiens
ARHFRRRAAGAGNTNGGRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761409 - protein, 162 aa, Homo sapiens; identical to SEQ ID NO: 761406

SEQ ID NO: 761410 - protein, 162 aa, Homo sapiens; identical to SEQ ID NO: 761406

SEQ ID NO: 761411 - protein, 87 aa, Homo sapiens
PGTSGGALQARGTPMAGYLKLVCVSFQRQGFHTVGSRCKNRTGAEHLWLTRHLRDPFVKAAKVESYRCRSAFKLLEIPALLLASCLG

SEQ ID NO: 761412 - protein, 89 aa, Homo sapiens
PGTSGGALQARGTPMAGYLKLVCVSFQRQGFHTVGSRCKNRTGAEHLWLTRHLRDPFVKAAKVESYRCRSAFKLLEMESHSCPGCSAMV

SEQ ID NO: 761413 - protein, 262 aa, Homo sapiens
ADIEELRRTLGLYLQRGSGAAYTRCGMHSGDVSRSVNPQRGVKQTSGLDGDQSPETPSVVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761414 - protein, 260 aa, Homo sapiens
PGTSGGALQARGTPMAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761415 - protein, 260 aa, Homo sapiens; identical to SEQ ID NO: 761414

SEQ ID NO: 761416 - protein, 169 aa, Homo sapiens
PGTSGGALQARGTPMAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDGVSLLPRLQCNGVISAHCNLCLPGSSDSPASASQVAGITGARHRTQLIFSFCFFK

SEQ ID NO: 761417 - protein, 432 aa, Homo sapiens
ARHFRRRAAGAGNTNGGVSWALLLRVQTAGVVGGPPGRLPRSWPRGWVPSAGHRPRTQRARQGRGQDSGSQFPGRRAPSGLQGQGRRGRGEAGAGGGVQVGGAAPGPRSKAPGASPGRDFASGPGSSIARASWAVEWALAPGTGLCHFPGRPLKRGEDSDSRSAVSASWLVSTLLVLQKLEALALEPGGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761418 - protein, 260 aa, Homo sapiens; identical to SEQ ID NO: 761414

SEQ ID NO: 761419 - protein, 312 aa, Homo sapiens
ARHFRRRAAGAGNTNGGVAGRCCCACRQREWLGVRPVAFLGPGLGAGCRALGTVPALSERDRGEARIPGRSSPGGGRPQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 761420 - protein, 169 aa, Homo sapiens; identical to SEQ ID NO: 761416

SEQ ID NO: 761421 - protein, 211 aa, Homo sapiens
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKVETGFHRVSQDGLNLLTSCSTLLDLPKCWDYRHEPPCPAGN

SEQ ID NO: 761422 - protein, 223 aa, Homo sapiens
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKDAASLAPISTNPTSIANPTKTLTKTSTPDPHASGYSSIAIAVVYPKTTIIPPK

SEQ ID NO: 761423 - protein, 120 aa, Homo sapiens
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMELCFVFI

SEQ ID NO: 761424 - protein, 211 aa, Homo sapiens; identical to SEQ ID NO: 761421

SEQ ID NO: 761425 - protein, 131 aa, Homo sapiens [sequence omitted]

SEQ ID NO: 761426 - protein, 288 aa, Homo sapiens
MQKASHKNKKERGVSNKVKTSVHNLSKTQQTKLTVGSLGLGLIIIQHGPYLQITHLIRKGAAANDEETPARLYRKHGWGGLRKLTIMAEGEEEGGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 761427 - protein, 116 aa, Homo sapiens
RTVTLTVRVRGFILEVSETKNPPIPDPMAHCNFEFPGSVSSPCLSLLNSWDYRHTESCQATFLFFVERRSRCEAQFGLKQVDSRDLPTSASQSASFTNVSHHVWPRTLPMSFYKKK

SEQ ID NO: 761428 - protein, 132 aa, Homo sapiens
QQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 761429 - protein, 105 aa, Homo sapiens
RFFTSLPVYAIIVANFCRSWTFYLLLISQPAYFEEVFGFAISKVGLLSAVPHMVMTIVVPIGGQLADYLRSRQILTTTAVRKIMNCGGTVDFIDGLGSFCRIRVN

SEQ ID NO: 761430 - protein, 2347 aa, Homo sapiens
MDPEQSVKGTKKAEGSPRKRLTKGEAIQTSVSSSVPYPGSGTAPTQESPAQELLAPQPFPGPSSVLREGSQEKTGQQQKPPKRPPIEASVHISHVPQHPLTPAFMSPGKPEHLLEGSTWQLVSPMRLGPSGSLLAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSRSSHVFTSHPRMLKPQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPAAGGPAREKKMLLGEKASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFKEGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGPLPCGSPRLQLSPLTLCPLGRELAPRAHVLSKLEGTTDPGLPRYSPTRRWSPGQAESPPRSAPPGKWALAGPGSPSAGEHGPGLGLAPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPANPEPSATPPLDRSSSVGCLAEASARFPARTRNLSGEPRTRQDSPKPSGSGEPRAHPHQPEDRVPPNA

SEQ ID NO: 761431 - protein, 141 aa, Homo sapiens
HIRTHTDVRPYVCKHCHFAFKTKGKRESAGALPLPAAGSSPLGVPAQSSGAQTSLQGAWSSPISWVPTQLGAQWQSSWLQTGLWLPMAAPSHPPGTHTQPLHLWPPGPGLPSLVRHSCSPFMVLHLLSSPLPSACLLSRLS

SEQ ID NO: 761432 - protein, 2406 aa, Homo sapiens
MDPEQSVKGTKKAEGSPRKRLTKGEAIQTSVSSSVPYPGSGTAPTQESPAQELLAPQPFPGPSSVLREGSQEKTGQQQKPPKRPPIEASVHISHVPQHPLTPAFMSPGKPEHLLEGSTWQLVSPMRLGPSGSLLAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSRSSHVFTSHPRMLKPQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPAAGGPAREKKMLLGEKASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGPLPCGSPRLQLSPLTLCPLGRELAPRAHVLSKLEGTTDPGLPRYSPTRRWSPGQAESPPRSAPPGKWALAGPGSPSAGEHGPGLGLAPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPANPEPSATPPLDRSSSVGCLAEASARFPARTRNLSGEPRTRQDSPKPSGSGEPRAHPHQPEDRVPPNA

SEQ ID NO: 761433 - protein, 699 aa, Homo sapiens
MRQDQQAGAGAESRQLVAVPGLLDPTFCWYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGPLPCGSPRLQLSPLTLCPLGRELAPRAHVLSKLEGTTDPGLPRYSPTRRWSPGQAESPPRSAPPGKWALAGPGSPSAGEHGPGLGLAPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPANPEPSATPPLDRSSSVGCLAEASARFPARTRNLSGEPRTRQDSPKPSGSGEPRAHPHQPEDRVPPNA

SEQ ID NO: 761434 - protein, 95 aa, Homo sapiens
PGRNSARARGTDEIIHHDQLGFFLEIQKGFNLCKTINVLHHINRMEDRNHTIISVDAEKTFDQKILLTVLSFLNLRTCFSKTFPESLYESTKFSS

SEQ ID NO: 761435 - protein, 1020 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 761436 - protein, 946 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIGM

SEQ ID NO: 761437 - protein, 491 aa, Homo sapiens
MDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 761438 - protein, 798 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPLTLRSLPREVSSTVVCPRLVLLL

SEQ ID NO: 761439 - protein, 825 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPR

SEQ ID NO: 761440 - protein, 207 aa, Homo sapiens
KPLLSPLLPLPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 761441 - protein, 172 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAGEAWEGSFRVGQTWVETSELNVQGNI

SEQ ID NO: 761442 - protein, 1020 aa, Homo sapiens; identical to SEQ ID NO: 761435

SEQ ID NO: 761443 - protein, 855 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTALPGPLL

SEQ ID NO: 761444 - protein, 752 aa, Homo sapiens
QSARDKDIGLRVAMGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTHAEGREV

SEQ ID NO: 761445 - protein, 166 aa, Homo sapiens
QSARDKDIGLRVAMGSGGDSLLGGRGSLPLLLLLIMGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 761446 - protein, 277 aa, Homo sapiens
MSFCPNQPGETTHPSSGDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 761447 - protein, 277 aa, Homo sapiens; identical to SEQ ID NO: 761446

SEQ ID NO: 761448 - protein, 278 aa, Homo sapiens
MSFCPNQPGETTHPSSGDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTCPCHSPGHQVMSLVRGNRDNLSVFSLCY

SEQ ID NO: 761449 - protein, 277 aa, Homo sapiens; identical to SEQ ID NO: 761446

SEQ ID NO: 761450 - protein, 277 aa, Homo sapiens; identical to SEQ ID NO: 761446

SEQ ID NO: 761451 - protein, 277 aa, Homo sapiens; identical to SEQ ID NO: 761446

SEQ ID NO: 761452 - protein, 202 aa, Homo sapiens
MPIFALKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 761453 - protein, 277 aa, Homo sapiens; identical to SEQ ID NO: 761446

SEQ ID NO: 761454 - protein, 142 aa, Homo sapiens
SAAAACNRTRVPCVCVRSPSAPSCGCPLPSYGPPWPRIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 761455 - protein, 277 aa, Homo sapiens; identical to SEQ ID NO: 761446

SEQ ID NO: 761456 - protein, 277 aa, Homo sapiens; identical to SEQ ID NO: 761446

SEQ ID NO: 761457 - protein, 182 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRGCWHAATRLSVL

SEQ ID NO: 761458 - protein, 193 aa, Homo sapiens
PGGESAEGSLCVCPLALCSVLRLPTALLRSTMALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRQRFFKFSRDVFLPKPTWGNHTPIFRGCWHAATRLSVL

SEQ ID NO: 761459 - protein, 277 aa, Homo sapiens; identical to SEQ ID NO: 761446

SEQ ID NO: 761460 - protein, 240 aa, Homo sapiens
MSFCPNQPGETTHPSSGDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQLCY

SEQ ID NO: 761461 - protein, 277 aa, Homo sapiens; identical to SEQ ID NO: 761446

SEQ ID NO: 761462 - protein, 277 aa, Homo sapiens; identical to SEQ ID NO: 761446

SEQ ID NO: 761463 - protein, 277 aa, Homo sapiens; identical to SEQ ID NO: 761446

SEQ ID NO: 761464 - protein, 135 aa, Homo sapiens
NPPLNGARIGIHGTDQDLQLYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 761465 - protein, 277 aa, Homo sapiens; identical to SEQ ID NO: 761446

SEQ ID NO: 761466 - protein, 182 aa, Homo sapiens; identical to SEQ ID NO: 761457

SEQ ID NO: 761467 - protein, 128 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDLLPLLNVVCSLSSHTVSPAAQGGTRKEDILGFACC

SEQ ID NO: 761468 - protein, 363 aa, Homo sapiens
SGVGGRQGIWLDWRAETHLAQPSLLNRSSSPADTATMKERRAPQPVVARCKLVLVGDVQCGKTAMLQVLAKDCYPEVSCPPARWPAFLPACPPWGRFPPAQETWLPQPQPILSRFLRLYHPQLLFGWRTALPELPLRPVPLLPPRWLLLTSSPRGPIRSPPPSCVPGVCSQTYVPTVFENYTACLETEEQRVELSLWDTSGSPYYDNVRPLCYSDSDAVLLCFDISRPETVDSALKKWRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 761469 - protein, 86 aa, Homo sapiens
ALNEEKVAYDLQLGAEIYLEGSAFTSEKSIHSIFRTASMLCLNKPSPLPQKSPVRSLSKRLLHLPSRSELISSTFKKEKAKSCSIM

SEQ ID NO: 761470 - protein, 268 aa, Homo sapiens
SGVGGRQGIWLDWRAETHLAQPSLLNRSSSPADTATMKERRAPQPVVARCKLVLVGDVQCGKTAMLQVLAKDCYPETYVPTVFENYTACLETEEQRVELSLWDTSGSPYYDNVRPLCYSDSDAVLLCFDISRPETVDSALKKWRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 761471 - protein, 197 aa, Homo sapiens
SSGIEDGIPRALGLRPIGEGKHHGITISSFWPTPGSPYYDNVRPLCYSDSDAVLLCFDISRPETVDSALKKWRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 761472 - protein, 248 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 761473 - protein, 248 aa, Homo sapiens; identical to SEQ ID NO: 761472

SEQ ID NO: 761474 - protein, 248 aa, Homo sapiens; identical to SEQ ID NO: 761472

SEQ ID NO: 761475 - protein, 248 aa, Homo sapiens; identical to SEQ ID NO: 761472

SEQ ID NO: 761476 - protein, 248 aa, Homo sapiens; identical to SEQ ID NO: 761472

SEQ ID NO: 761477 - protein, 248 aa, Homo sapiens; identical to SEQ ID NO: 761472

SEQ ID NO: 761478 - protein, 248 aa, Homo sapiens; identical to SEQ ID NO: 761472

SEQ ID NO: 761479 - protein, 248 aa, Homo sapiens; identical to SEQ ID NO: 761472

SEQ ID NO: 761480 - protein, 248 aa, Homo sapiens; identical to SEQ ID NO: 761472

SEQ ID NO: 761481 - protein, 248 aa, Homo sapiens; identical to SEQ ID NO: 761472

SEQ ID NO: 761482 - protein, 248 aa, Homo sapiens; identical to SEQ ID NO: 761472

SEQ ID NO: 761483 - protein, 248 aa, Homo sapiens; identical to SEQ ID NO: 761472

SEQ ID NO: 761484 - protein, 248 aa, Homo sapiens; identical to SEQ ID NO: 761472

SEQ ID NO: 761485 - protein, 259 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGVSWGALLSQEKIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 761486 - protein, 173 aa, Homo sapiens
IPVFMTFWLYYILIYEHMTAGGNCQTFSSSTVISYSNTGDGAPKVYQETSEMRSAPGGIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 761487 - protein, 172 aa, Homo sapiens [sequence omitted]

SEQ ID NO: 761488 - protein, 122 aa, Homo sapiens
MLTVSALFGRHELTVRHSNRAVEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 761489 - protein, 109 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCLYFLICATCN

SEQ ID NO: 761490 - protein, 135 aa, Homo sapiens
SSPQGSAPPRRPQSARLSPRGICPSSSSFPLRRERERAALRPQVQPPTRSLPKNGFLFSFSSPALWEPLPVHRTQIEVTNELPFFVPRGPLSASGSAPLSLAHGPGAPGTRPQPSHHPRQGAGLPRPGPGWAGLS

SEQ ID NO: 761491 - protein, 248 aa, Homo sapiens; identical to SEQ ID NO: 761472

SEQ ID NO: 761492 - protein, 172 aa, Homo sapiens [sequence omitted]

SEQ ID NO: 761493 - protein, 166 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQR

SEQ ID NO: 761494 - protein, 196 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQRSRNHRTGDQEERQDYINLDETAPFPYLFLL

SEQ ID NO: 761495 - protein, 155 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMVRLAPYPSPALLSVMADNTLHPLRQEGNSMLVKGKVLDKVIEPESLGTLYLLSCLPEAAGSSSLT

SEQ ID NO: 761496 - protein, 135 aa, Homo sapiens; identical to SEQ ID NO: 761490

SEQ ID NO: 761497 - protein, 98 aa, Homo sapiens
ADESFAPITKVFLPGPPVSRLKSEFALTIKNVIALAALQFVTDVIANENVIVRTIPSVGKAVISVLSTLTSSGSASSSAKHALTNQGIHSDNLWAPIT

SEQ ID NO: 761498 - protein, 131 aa, Homo sapiens
MAMGPRLGPHACVVGTTVTVPRVGRGPVMAESWSGQALQALPATVLGALGSEFLREWEAQDMRVTLFKLLLLWLVLSLLGIQLAWGFYGNTVTGLYHRPGLGGQNGSTPDGSTHFPSWEMAANEPLKTHRE

SEQ ID NO: 761499 - protein, 103 aa, Homo sapiens
MAESWSGQALQALPATVLGALGSEFLREWEAQDMRVTLFKLLLLWLVLSLLGIQLAWGFYGNTVTGLYHRPGLGGQNGSTPDGSTHFPSWEMAANEPLKTHRE

SEQ ID NO: 761500 - protein, 103 aa, Homo sapiens; identical to SEQ ID NO: 761499

SEQ ID NO: 761501 - protein, 106 aa, Homo sapiens
MAESWSGQALQALPATVLGALGSEFLREWEAQDMRVTLFKLLLLWLVLSLLGIQLAWGFYGNTVTGLYHRPGEASYEPPWAGRPRPHPLPTVPLGSPLSCKRLIRT

SEQ ID NO: 761502 - protein, 103 aa, Homo sapiens; identical to SEQ ID NO: 761499

SEQ ID NO: 761503 - protein, 103 aa, Homo sapiens; identical to SEQ ID NO: 761499

SEQ ID NO: 761504 - protein, 103 aa, Homo sapiens; identical to SEQ ID NO: 761499

SEQ ID NO: 761505 - protein, 103 aa, Homo sapiens; identical to SEQ ID NO: 761499

SEQ ID NO: 761506 - protein, 244 aa, Homo sapiens
MAESWSGQALQALPATVLGALGSEFLREWEAQDMRVTLFKLLLLWLVLSLLGIQLAWGFYGNTVTGLYHRPGPSPDFTKQYQWSLTCPGLMPAQIPTPAFCSSGCVSASVWVVRMDPRLMAPRISLRGKWQQTNLSKPTENKGRQQRVSKGITGSAGFYTGFCYSPDLRDNCRGFRVGSREYPVPTGLGLFCLLSLLPHPGTGQVKSLPVLLSGCLKERDCVLPLSGVITQEASGLGRPSVLLS

SEQ ID NO: 761507 - protein, 179 aa, Homo sapiens [sequence omitted]

SEQ ID NO: 761508 - protein, 106 aa, Homo sapiens; identical to SEQ ID NO: 761501

SEQ ID NO: 761509 - protein, 465 aa, Homo sapiens
AGGGGALGSPRRTAAMEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 761510 - protein, 177 aa, Homo sapiens
MGIWCTDHFITQYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 761511 - protein, 403 aa, Homo sapiens [sequence omitted]

SEQ ID NO: 761512 - protein, 465 aa, Homo sapiens; identical to SEQ ID NO: 761509

SEQ ID NO: 761513 - protein, 176 aa, Homo sapiens
RAAEAHWVRRAELQPWSRHLRTPSGSSSRRPWSRWAPQTLGWGLRSARKRRGPEKRALGSTRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKEIY

SEQ ID NO: 761514 - protein, 287 aa, Homo sapiens
MDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLIMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 761515 - protein, 419 aa, Homo sapiens
AGGGGALGSPRRTAAMEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGSVWDPLRP

SEQ ID NO: 761516 - protein, 465 aa, Homo sapiens; identical to SEQ ID NO: 761509

SEQ ID NO: 761517 - protein, 305 aa, Homo sapiens
MDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 761518 - protein, 499 aa, Homo sapiens
AGGGGALGSPRRTAAMEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKSPHPCHPRLECNGMILSLTYNPPPSRVQAILPHPARVDGITGNSSLDQC

SEQ ID NO: 761519 - protein, 465 aa, Homo sapiens; identical to SEQ ID NO: 761509

SEQ ID NO: 761520 - protein, 1668 aa, Homo sapiens
MSQLRLATLSLDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761521 - protein, 124 aa, Homo sapiens
MLATTFPIQIHITFPHEKYHIKFDPQIEESYMVPTFSLPWDVGAPGCYLTRVPSTAGLGKGKENAFSLGATLWINSEEFEDLDEIVARYVQPMASFARDLLNHKYYYSWPSSPAQGILVETTAQ

SEQ ID NO: 761522 - protein, 1627 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761523 - protein, 1726 aa, Homo sapiens
MSDFVESEAEESEEEYNDEGEVVPRVTKKFVEEEDDDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761524 - protein, 979 aa, Homo sapiens
DRVLDLDAFAEELERQGYGDKHITLYDIRAELSCRYKDLRTAYRSPNTEEIFNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761525 - protein, 658 aa, Homo sapiens
MAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761526 - protein, 633 aa, Homo sapiens
MARYEALVVNRPRLCRRAGEAGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761527 - protein, 606 aa, Homo sapiens
LEDPGLHKGSNPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761528 - protein, 1358 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYDRICNGDSRGIPVPGPDLPNREWTV

SEQ ID NO: 761529 - protein, 429 aa, Homo sapiens
DGCDGAGEATVNHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761530 - protein, 1455 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLAARSRLDRA

SEQ ID NO: 761531 - protein, 373 aa, Homo sapiens
VGITGSTRMRQDEHGYISRCFTRKYTLPPGVDPTQVSSSLSPEGTLTVEAPMPKLATQSNEITIPVTFESRAQLEKQWWARSSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761532 - protein, 627 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761533 - protein, 1103 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQATVKNVTAPHRRCYTT

SEQ ID NO: 761534 - protein, 106 aa, Homo sapiens
LQEAQEIFGVDFDYDEFEKYNEYDEELEEEYEYEDDEAEGEIRVRPKKTTKKRVSRRSIFEMYEPSELESSHLTDQDNEIRATDLPERFQVKNHQPLLFYQSIITL

SEQ ID NO: 761535 - protein, 1726 aa, Homo sapiens; identical to SEQ ID NO: 761523

SEQ ID NO: 761536 - protein, 130 aa, Homo sapiens
VGITGSTRMRQDEHGYISRCFTRKYTLPPGVDPTQVSSSLSPEGTLTVEAPMPKLATQSNEITIPVTFESRAQLEKQWWARSSGGDRKKLEELLIKTKKEKPTFIPYFICACKELPGKFLLGYQPRGKPR

SEQ ID NO: 761537 - protein, 1703 aa, Homo sapiens
MKSSGSAQKLSHRDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761538 - protein, 1714 aa, Homo sapiens
MIPPSNISFVVPRVTKKFVEEEDDDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761539 - protein, 827 aa, Homo sapiens
MAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761540 - protein, 781 aa, Homo sapiens
MKSSGSAQKLSHRDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761541 - protein, 607 aa, Homo sapiens
ATPLSSRVLTPMACPGHEPLSKWRHTSLSSGKFALLTEGALPQPRKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761542 - protein, 1627 aa, Homo sapiens; identical to SEQ ID NO: 761522

SEQ ID NO: 761543 - protein, 1638 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQALFQLPATAAAAKSNRHAASTGENADSGAGKARTGKRSGCNSGPPARRDPGWGSPPGREEAAQPEPGKGRGPACKGRTGTEGKGDPPPGGALLVAGTS

SEQ ID NO: 761544 - protein, 348 aa, Homo sapiens
SRKRHRGKGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761545 - protein, 1214 aa, Homo sapiens
LEDDDFLLNEVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGSSRSTRPPWGTALTHILKSLMVPVSTLRLMSGLGRWQWMPWNTMNQPRMPILQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761546 - protein, 244 aa, Homo sapiens
MIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761547 - protein, 145 aa, Homo sapiens
GRSLVTRSCVRSSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 761548 - protein, 290 aa, Homo sapiens
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 761549 - protein, 126 aa, Homo sapiens
RQTYSRFLFVYQELLVVSSTETFEKERQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 761550 - protein, 171 aa, Homo sapiens
PSAGLLVPVTLTFRAVLWCENASPRQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 761551 - protein, 131 aa, Homo sapiens
LSLWMRVKHVQVVVGVLKHKKVAPSCVPVLKGAHAADSSRSKWPALMGTGRKSFGAFLFHHSFSWGWKLISISFGDLNPFPVRQIRNQRAYHLEKVRLELTELEAIREDFLHERDTSPDKGELVSDEEEDT

SEQ ID NO: 761552 - protein, 359 aa, Homo sapiens
TNKLEQPRGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 761553 - protein, 657 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 761554 - protein, 681 aa, Homo sapiens
HHSFLTWHNLRFLDSEEQLELIHIMEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 761555 - protein, 657 aa, Homo sapiens; identical to SEQ ID NO: 761553

SEQ ID NO: 761556 - protein, 657 aa, Homo sapiens; identical to SEQ ID NO: 761553

SEQ ID NO: 761557 - protein, 422 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQVGFPQS

SEQ ID NO: 761558 - protein, 437 aa, Homo sapiens
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQLLQPYSNSYHTCD

SEQ ID NO: 761559 - protein, 359 aa, Homo sapiens; identical to SEQ ID NO: 761552

SEQ ID NO: 761560 - protein, 657 aa, Homo sapiens; identical to SEQ ID NO: 761553

SEQ ID NO: 761561 - protein, 657 aa, Homo sapiens; identical to SEQ ID NO: 761553

SEQ ID NO: 761562 - protein, 633 aa, Homo sapiens
AAAPSAASAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGHVSPEDPGMGSQVQPGPGRVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGAEFWTRYEGATFLTVDTNAWRHRCSWQKPSCLTKRPSGPAWRRINVGGTPRMIWGRCGQGTVTPSLEGSRAVSLWGLHFLPSPVIRKDDFHVHSELSGFIWRAAP

SEQ ID NO: 761563 - protein, 633 aa, Homo sapiens; identical to SEQ ID NO: 761562

SEQ ID NO: 761564 - protein, 633 aa, Homo sapiens; identical to SEQ ID NO: 761562

SEQ ID NO: 761565 - protein, 270 aa, Homo sapiens
MQYPHPGPAAGAVGVPLYAPTPLLQPAHPTPFYIEDILGRGPAAPTPAPTLPSPNSSFTSLVSPYRTPVYEPTPIHPAFSHHSAAALAAAYGPGGFGGPLYPFPRTVNDYTHALLRHDPLGKPLLWSPFLQRPLHKRKGGQVRFSNDQTIELEKKFETQKYLSPPERKRLAKMLQLSERQVKTWFQNRRAKWRRLKQENPQSNKKEELESLDSSCDQRQDLPSEQNKGASLDSSQCSPSPASQEDLESEISEDSDQEVDIEGDKSYFNAG

SEQ ID NO: 761566 - protein, 189 aa, Homo sapiens
MALTFYLMVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLEVLCDQEVGVIESPLMYEDSILAVRKYFQRITLYLTEKKYSSCAWEVVRAEIMRSFSLSINLQKRLKSKE

SEQ ID NO: 761567 - protein, 132 aa, Homo sapiens [sequence omitted]

SEQ ID NO: 761568 - protein, 393 aa, Homo sapiens [sequence omitted]

SEQ ID NO: 761569 - protein, 371 aa, Homo sapiens
MRLERTNLEALQKKLEELELDEQQRKRLEAFLTQKQKVGELKDDDFEKISELGAGNGGVVFKVSHKPSGLVMARKLIHLEIKPAIRNQIIRELQVLHECNSPYIVGFYGAFYSDGEISICMEHMDGGSLDQVLKKAGRIPEQILGKVSIAVIKGLTYLREKHKIMHRDVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 761570 - protein, 337 aa, Homo sapiens
SRVGVWKAPHPGWEARLPLPRPSPGLQSLPGPLRRAARSTAAAALSPAGLQVLHECNSPYIVGFYGAFYSDGEISICMEHMDGGSLDQVLKKAGRIPEHNFFRNNVQHLPVHYTQCPGQYSDGAEATRISAPADVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 761571 - protein, 360 aa, Homo sapiens
FPRDVSLQRTQSLFFKFFPKMSFPNSSPAANTFLVDSLISACRSDSFYSSSASMYMPPPSADMGTYGMQTCGLLPSLAKREVNHQNMGMNVHPYIPQVDSWTDPNRSCRIEQPVTQQVPTCSFTTNIKEESNCCMYSDKRNKLISAEVPSYQRLVPESCPVENPEVPVPGYFRLSQTYATGKTQEYNNSPEGSSTVMLQLNPRGAAKPQLSAAQLQMEKKMNEPVSGQEPTKVSQVESPEAKGGLPEERSCLAEVSVSSPEVQEKESKEEIKSDTPTSNWLTAKSGRKKRCPYTKHQTLELEKEFLFNMYLTRERRLEISKSVNLTDRQVKIWFQNRRMKLKKMSRENRIRELTANLTFS

SEQ ID NO: 761572 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 761573 - protein, 475 aa, Homo sapiens; identical to SEQ ID NO: 761572

SEQ ID NO: 761574 - protein, 237 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGE

SEQ ID NO: 761575 - protein, 475 aa, Homo sapiens; identical to SEQ ID NO: 761572

SEQ ID NO: 761576 - protein, 399 aa, Homo sapiens [sequence omitted]

SEQ ID NO: 761577 - protein, 78 aa, Homo sapiens
GNSFRQVQPFMRNSPVVTFQFLDLLPPSELHAPSSDFLRMTQVIGGVKSRFPTQSPEEMEIPFMELEVPGDLGIQITS

SEQ ID NO: 761578 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 761579 - protein, 119 aa, Homo sapiens
MGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 761580 - protein, 188 aa, Homo sapiens; identical to SEQ ID NO: 761578

SEQ ID NO: 761581 - protein, 172 aa, Homo sapiens
MAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 761582 - protein, 300 aa, Homo sapiens
MLPLLAALLAAACPLPPVRGGAADAPGLLGVPSNASVNASSADEPIAPRLLASAAPGPPERPGPEETAAAAAPCNISVQRQMLSSLLVRWGRPRGFQCDLLLFSTNAHGRAFFAAAFHRVGPPLLIEHLGLAAGGAHRDLRLCVGCGWVRGRRTGRLRPAAAPSAAAATAGAPTALPAYPAAEPPGPLWLQGEPLHFCCLDFSLEELQGEPGWRLNRKPIESTLVACFMTLVIVVWSVAALIWPVPIIAGFLPNGMEQRRTTASTTAATPAAVPAGTTAAAAAAAAAAAAAAVTSGVATK

SEQ ID NO: 761583 - protein, 300 aa, Homo sapiens; identical to SEQ ID NO: 761582

SEQ ID NO: 761584 - protein, 274 aa, Homo sapiens
MATTVSTQRGPVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761585 - protein, 274 aa, Homo sapiens; identical to SEQ ID NO: 761584

SEQ ID NO: 761586 - protein, 246 aa, Homo sapiens
MATTVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761587 - protein, 150 aa, Homo sapiens
CGVCTLDAVWLSLEVSPRPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPWSRSI

SEQ ID NO: 761588 - protein, 274 aa, Homo sapiens; identical to SEQ ID NO: 761584

SEQ ID NO: 761589 - protein, 274 aa, Homo sapiens; identical to SEQ ID NO: 761584

SEQ ID NO: 761590 - protein, 274 aa, Homo sapiens; identical to SEQ ID NO: 761584

SEQ ID NO: 761591 - protein, 351 aa, Homo sapiens
MQKAWVSTCKEYHVDPCEGYRGGPCEGYCVDPCEEYHGGPCEGYRAGPREEYRGVPCGPLPSAVRSRDVCGRLRCSHRGAVREASLVEVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761592 - protein, 224 aa, Homo sapiens
MATTVSTQRGPAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761593 - protein, 146 aa, Homo sapiens
LEDTAEITYIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761594 - protein, 274 aa, Homo sapiens; identical to SEQ ID NO: 761584

SEQ ID NO: 761595 - protein, 268 aa, Homo sapiens
MATTVSTQRGPVYIGELPQDFLRITPTQQQRQVQLDAQAAQQLQYGGAVGTVGRLNITVVQGTEAKKSQEYTGKTRIEDPEQARRTPRDYTRKTRQPTGTRMGGRRNTPLGKRVQPQSTGAPQGVDYYFYSARILTKERGLAPRDQPQKPEKRHKHQRQKTQESRNQIDERQEGIEAEPGVQYGVRYGYWKGDAAAKSANRDLRTRSEPGRKEAEAASRMEGRKKTEAGENRGEGGRVRERREPVINAPLGRRILPIVKWAGETRMRA

SEQ ID NO: 761596 - protein, 274 aa, Homo sapiens; identical to SEQ ID NO: 761584

SEQ ID NO: 761597 - protein, 274 aa, Homo sapiens; identical to SEQ ID NO: 761584

SEQ ID NO: 761598 - protein, 246 aa, Homo sapiens; identical to SEQ ID NO: 761586

SEQ ID NO: 761599 - protein, 188 aa, Homo sapiens
RLVEARVNLAEATWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 761600 - protein, 274 aa, Homo sapiens; identical to SEQ ID NO: 761584

SEQ ID NO: 761601 - protein, 74 aa, Homo sapiens
SSRVQAPPTGDVTALGRLGRFRVSLPWRPWAARASLQAESPASRIASEAWQPVTLPKGLNYSGASPVVLNAVLP

SEQ ID NO: 761602 - protein, 378 aa, Homo sapiens
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPSRRPPHPQEALPLFEIPDPGTGARVFLQRVYQQREAAAAVPDAEPDGPTSENLVSEQKDERKETEQRPAAVFLGKSSAVTCRPGPFGGGGRGKLFYFIFIFYFLTRLLSAGGKLDCGQGWPPPLWPALHSGTSWTLYLTLAVGQGPGLERG

SEQ ID NO: 761603 - protein, 317 aa, Homo sapiens
KNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKSFGTGPQGGITQEWIGVEGDPPGANIASQEQMLCVYLQCSSHKAISDQRVQPLLCCFLNVPGNSS

SEQ ID NO: 761604 - protein, 92 aa, Homo sapiens
MKPIQKLLAGLILLTSCVEGCSSQHWSYGLRPGGKRDAENLIDSFQEIVKEVGQLAETQRFECTTHQPRSPLRDLKGALESLIEEETGQKKI

SEQ ID NO: 761605 - protein, 92 aa, Homo sapiens
MKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 761606 - protein, 92 aa, Homo sapiens; identical to SEQ ID NO: 761604

SEQ ID NO: 761607 - protein, 101 aa, Homo sapiens
MVARLGTFLKNAWAREPVLVVSFIIGSLAVILPPLSPYTKYFIMIYETMPYNYPLPVRNDGNMTNVPGHPQDPQSSSLEWLKKLSTSTDRGGPSHRSQYEC

SEQ ID NO: 761608 - protein, 85 aa, Homo sapiens
EQPERQETPGCWVPRMARMGSREEHIALGHCAEPEPRTEMRTVVDSATWSHSYKTCSSFAGTGTLRVAGAAATWAGSVETHSGKL

SEQ ID NO: 761609 - protein, 81 aa, Homo sapiens
GTCWSQRRNSQGFSITCLGMGRSWRRTAVARDHMSTDLLALAAAVAAVAMGLCHAPVLGEHLQISGCLGIGHGKVKRSHGS

SEQ ID NO: 761610 - protein, 77 aa, Homo sapiens
VSAGGGLGPQAQTRPPTPISYKEELYRCLYYYCLRYFPACGVGRSKGLTLSEQALRTKRLSPGGHVQAEAPQWPQVR

SEQ ID NO: 761611 - protein, 126 aa, Homo sapiens
IHAQGHLKLLQKFRLGQHNLRAPVPWIGAKQSGHLTRDLQRCKDTLTSCVGEGVTQLAGTQWPRGSDNLALFPNPDRPLFQDRDPGHRSKNNNHKSIPHPGKGPDAYSADSGQERGWSVCLTGSAW

SEQ ID NO: 761612 - protein, 210 aa, Homo sapiens
MNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 761613 - protein, 210 aa, Homo sapiens; identical to SEQ ID NO: 761612

SEQ ID NO: 761614 - protein, 210 aa, Homo sapiens; identical to SEQ ID NO: 761612

SEQ ID NO: 761615 - protein, 139 aa, Homo sapiens
MPFLGQDWRSPGQNWVKTADGWKRFLDEKSGSFVSDLSTVTCHTGRYSNNGRTLFRHSLHYDCLQPQKTEHERTMLETSNHRKHQGISTKNTTGIYVHKRNVLKSAMDIAPWGKLSTDWTSQLPFWIPEDLTTWSGPCH

SEQ ID NO: 761616 - protein, 210 aa, Homo sapiens; identical to SEQ ID NO: 761612

SEQ ID NO: 761617 - protein, 1434 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 761618 - protein, 1468 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKYPEPLRFFPRKGPPLPNGDTEVHGLAAARDSQHRSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 761619 - protein, 1434 aa, Homo sapiens; identical to SEQ ID NO: 761617

SEQ ID NO: 761620 - protein, 103 aa, Homo sapiens
MSHCTCQLLLLFCLLPGPPQVLMGSMWQLGSSLSLSISLAQGLQEYEEWKWGKNPTIVEVLEEFPSIQMPATLLLTQLSLLQPRYYSISSSPDMYPDEVHLTV

SEQ ID NO: 761621 - protein, 104 aa, Homo sapiens
MRLRTERMPSKKWHFRIYTAPQHAAKRGHTTTTARSRAAGTRSLSSAPCVASSESRHLIHSLGLRLLRYCNCLDWSILGQHGGAHVTRSVPQSERRPRRGPRGG

SEQ ID NO: 761622 - protein, 104 aa, Homo sapiens; identical to SEQ ID NO: 761621

SEQ ID NO: 761623 - protein, 250 aa, Homo sapiens
TDAFLLSQLQEECLPLILILLSTDPLRVSGWGTVRSFPSHEAIFQTITWGETLDNTWLSKAEVPAAFRSFCVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 761624 - protein, 155 aa, Homo sapiens
MLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 761625 - protein, 169 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKN

SEQ ID NO: 761626 - protein, 181 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNPPYTSYIKRDRL

SEQ ID NO: 761627 - protein, 104 aa, Homo sapiens; identical to SEQ ID NO: 761621

SEQ ID NO: 761628 - protein, 257 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 761629 - protein, 226 aa, Homo sapiens
DAWVDPRVRQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 761630 - protein, 251 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPI

SEQ ID NO: 761631 - protein, 224 aa, Homo sapiens
MVLSPLFSAVGLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 761632 - protein, 104 aa, Homo sapiens; identical to SEQ ID NO: 761621

SEQ ID NO: 761633 - protein, 120 aa, Homo sapiens
MPLWTHSSNITALLERETSPPCASVSSSESEWRGLPCEKSELCPWAGWLRCSAPRITCPSNVPAPVSFLPTSFHHLGPGKGRAWSRAAENGLRCLAKELQGSNQRLMWHAGWGEGNTEDP

SEQ ID NO: 761634 - protein, 115 aa, Homo sapiens
MPFRTDLPINYRDEKSSGIRKRELIPWLAAIAPVHGATYMCDIRVRSHAIGPGPLAGLATIFLPSLVTSLMALLGPPHVCVAPALGHPCRPSFSPRGAHLNPHFWEACVPRDHPR

SEQ ID NO: 761635 - protein, 115 aa, Homo sapiens
MVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGRGGHRVQTQLRGW

SEQ ID NO: 761636 - protein, 115 aa, Homo sapiens; identical to SEQ ID NO: 761635

SEQ ID NO: 761637 - protein, 115 aa, Homo sapiens; identical to SEQ ID NO: 761635

SEQ ID NO: 761638 - protein, 104 aa, Homo sapiens
MVKLTLEGKQTKRALALTGEARPRFLWQGKYKCHFFNGTERVQFLERLFYNQEEFVRFDSDVGEYRAVTELGRPVAESWNSQKDILEDRRGRGGHRVQTQLRGW

SEQ ID NO: 761639 - protein, 297 aa, Homo sapiens
MVCLKLPGGSCMAALTVTLMVLSSPLALAGDTQPRYLWQGKYKVSILFLTGDGAAVTVVTGTEELYLITPTGRGDSLAASEHDSSLLAVRYPRTDDSEVCGWPDDRVSGQQSAQDHPWQGRSAGSQVDNQSCDGTPTSRVVRSHERFTSATQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 761640 - protein, 115 aa, Homo sapiens; identical to SEQ ID NO: 761635

SEQ ID NO: 761641 - protein, 115 aa, Homo sapiens; identical to SEQ ID NO: 761635

SEQ ID NO: 761642 - protein, 133 aa, Homo sapiens
MSLWAARGRGYGWDQLRFQCQHPAQGAPDGGVSVSVFPGGRPCDRILRVPTARFLWQGKYKCHFFNGTERVQFLERLFYNQEEFVRFDSDVGEYRAVTELGRPVAESWNSQKDILEDRRGRGGHRVQTQLRGW

SEQ ID NO: 761643 - protein, 126 aa, Homo sapiens
VPNSARAARASMVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGRGGHRVQTQLRGW

SEQ ID NO: 761644 - protein, 585 aa, Homo sapiens
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761645 - protein, 490 aa, Homo sapiens
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARCQICLQTLPLCTLPGLIQFLGMTNTLVEREKCLCSGCD

SEQ ID NO: 761646 - protein, 585 aa, Homo sapiens; identical to SEQ ID NO: 761644

SEQ ID NO: 761647 - protein, 436 aa, Homo sapiens [sequence omitted]

SEQ ID NO: 761648 - protein, 392 aa, Homo sapiens
VFSCWSGAEFLLQNIERSGRKGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761649 - protein, 494 aa, Homo sapiens
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRRLQRAEIMPLYSSLGNRVRLHLKTKQNKTKQKNPALLLLTLLPSVPL

SEQ ID NO: 761650 - protein, 218 aa, Homo sapiens
ESSSVPPDCLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761651 - protein, 144 aa, Homo sapiens
VPATTLLLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761652 - protein, 585 aa, Homo sapiens; identical to SEQ ID NO: 761644

SEQ ID NO: 761653 - protein, 309 aa, Homo sapiens
MGSLKEELLKAIWHAFTALDQDHSGKVSKSQLKVLSHNLCTVLKVPHDPVALEEHFRDDDEGPVSNQGYMPYLNRFILEKIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLDLTKMEETGFSRTLSDQTWTQASDKRRTGWFKPFILLSSVSGRLHTKEPHVEIGERGDKDGGRGRAETGAREGAARQETHRPHRRDTRGPRKGNTTAGVKHG

SEQ ID NO: 761654 - protein, 585 aa, Homo sapiens; identical to SEQ ID NO: 761644

SEQ ID NO: 761655 - protein, 527 aa, Homo sapiens [sequence omitted]

SEQ ID NO: 761656 - protein, 245 aa, Homo sapiens [sequence omitted]

SEQ ID NO: 761657 - protein, 194 aa, Homo sapiens
MSFSDSRCPEHGCLKAPLEFAYKFNCSYGSLEQVAVCCVSALEDERQARQDEETVRKLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761658 - protein, 122 aa, Homo sapiens
MEVAFCLQSNCMPTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 761659 - protein, 100 aa, Homo sapiens
VIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIR

SEQ ID NO: 761660 - protein, 358 aa, Homo sapiens
ASGTQFASKTLPGSRYQLQTTAPDSSGIQLDFGKQSSSESQLSFGTQPSSGTQISSRIQASSGSQLSSGTQLISGAQPSSRTQTSSGNQLSSGTQTTARIQLSPGAHLSSRTQSSPETRLSSEAQSSSGTQFSSGIQFGSETQTGSRIQPDSGAQLSSRTQSSSETGLSSETQTGSRIQPSPGAHLSSGTQPVSGTQSSSRTHTSSRIWLSPGNGICPQTPGLDPRIQLEAPAPAQPQPPGPSPRDPTPAPSKDPQPLPQPHDQVCGIQASLGPIPGLPQASYLAPQSQVSSTPQKPAVSPKPRVGPQKSTPPTISVTPSPAPRAALLSSQLSESPALAPALCPTLGEPGARPYRGGP

SEQ ID NO: 761661 - protein, 141 aa, Homo sapiens
MSEHSRNSDQEELLDEEINEDEILANLSAEELKELQSEMEVMAPDPSLPVGMIQKDQTDKPPTGNFNHKSLVDYMYWEKASRRMLEEERVPVTFVKSEEKTQEEHEEIEKRNKNMAQYLKEKLNNEIVANKRESKGSSNIQ

SEQ ID NO: 761662 - protein, 105 aa, Homo sapiens
MSEHSRNSDQEELLDEEINEDEILANLSAEELKELQSEMEVMAPDPSLPVGMIQKDQTDKPPTGNFNHKSLVDYMYWEKASRRMLEEERVPVTFVKSEEKTQEDA

SEQ ID NO: 761663 - protein, 84 aa, Homo sapiens
HALHVFHCLFSSRLGTPVSPRLAMDPNCSCEAGGSCACAGSCKCKKCKCTSCKKSCCSCCPLGCAKCAQGCICKGASEKCSCCA

SEQ ID NO: 761664 - protein, 108 aa, Homo sapiens
HALHVFHCLFSSRLGTPVSPRLAMDPNCSCEAGGSCACAGSCKCKKCKCTSCKKSECGAISRNLGLWLRLGGNPRLALSACFLCPPRPSLPFQSSALSRAPVGLGSLS

SEQ ID NO: 761665 - protein, 319 aa, Homo sapiens
MEPGNDTQISEFLLLGFSQEPGLQPFLFGLFLSMYLVTVLGNLLIILATISDSHLHTPMYFFLSNLSFADICVTSTTIPKMLMNIQTQNKVITYIACLMQMYFFILFAGFENFLLSVMAYDRFVAICHPLHYMVIMNPHLCGLLVLASWTMSALYSLLQILMVVRLSFCTALEIPHFFCELNQVIQLACSDSFLNHMVIYFTVALLGGGPLTGILYSYSKIISSIHAISSAQGKYKAFSTCASHLSVVSLFYGAILGVYLSSAATRNSHSSATASVMYTVVTPMLNPFIYSLRNKDIKRALGIHLLWGTMKGQFFKKCP

SEQ ID NO: 761666 - protein, 109 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQEETEETSSQESAEED

SEQ ID NO: 761667 - protein, 103 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWHSQSASEELIRIMQASSLSH

SEQ ID NO: 761668 - protein, 105 aa, Homo sapiens
MTDTFPSLNCTLFPCTQRWPERARHNKLFRRSLLRRKLKRHPHKSLPKRTRGRQRSISTSAAVGSFEGRRHCSDHLFCIAMVFPLSSGVGWGGVGEGGVGWGEIT

SEQ ID NO: 761669 - protein, 182 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEVRVSQLLAVTGKKTTRP

SEQ ID NO: 761670 - protein, 135 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQVG

SEQ ID NO: 761671 - protein, 187 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEARRQQDPSPGSNLGGGDDLKLR

SEQ ID NO: 761672 - protein, 187 aa, Homo sapiens; identical to SEQ ID NO: 761671

SEQ ID NO: 761673 - protein, 182 aa, Homo sapiens; identical to SEQ ID NO: 761669

SEQ ID NO: 761674 - protein, 166 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMET

SEQ ID NO: 761675 - protein, 187 aa, Homo sapiens; identical to SEQ ID NO: 761671

SEQ ID NO: 761676 - protein, 187 aa, Homo sapiens; identical to SEQ ID NO: 761671

SEQ ID NO: 761677 - protein, 187 aa, Homo sapiens; identical to SEQ ID NO: 761671

SEQ ID NO: 761678 - protein, 201 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMENEVESVTGMLNEAEGKAIKLAKDVASLSSQLQDTQE

SEQ ID NO: 761679 - protein, 179 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMESCFKKKPGRSSTCL

SEQ ID NO: 761680 - protein, 94 aa, Homo sapiens
DGVASCIPGGSIDWHSHSQEYSSILWSNQSCTHHINPTLRHKAQKHSLTQVHTAMGEGDPCNAVCTELDSTQVSLTGGLDNKMWCWLTNKYDRI

SEQ ID NO: 761681 - protein, 645 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 761682 - protein, 645 aa, Homo sapiens; identical to SEQ ID NO: 761681

SEQ ID NO: 761683 - protein, 645 aa, Homo sapiens; identical to SEQ ID NO: 761681

SEQ ID NO: 761684 - protein, 266 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMER

SEQ ID NO: 761685 - protein, 645 aa, Homo sapiens; identical to SEQ ID NO: 761681

SEQ ID NO: 761686 - protein, 351 aa, Homo sapiens [sequence omitted]

SEQ ID NO: 761687 - protein, 112 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCE

SEQ ID NO: 761688 - protein, 199 aa, Homo sapiens
TWLQGMQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKETQGMNYWQGWKKHCEGRDLSDWKKDCEVS

SEQ ID NO: 761689 - protein, 206 aa, Homo sapiens
TWLQGMQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKESKAGRNTVRGETCPTGKKTVRFPKLELDPGCFAATP

SEQ ID NO: 761690 - protein, 199 aa, Homo sapiens; identical to SEQ ID NO: 761688

SEQ ID NO: 761691 - protein, 175 aa, Homo sapiens
TWLQGMQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKENCEVS

SEQ ID NO: 761692 - protein, 129 aa, Homo sapiens
TWLQGMQDAPLSCLSPTKWSSVSSADSTEKSASAAGTRNLPFQFCLRQALRMKAAGILTLIGCLVTGAESKIYTRCKWNWTQDALQQRPRVCSECPNACVILSRFLPIFLLKLGEGKLSYTFKKINISI

SEQ ID NO: 761693 - protein, 1079 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 761694 - protein, 1240 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIK

SEQ ID NO: 761695 - protein, 207 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAESKYF

SEQ ID NO: 761696 - protein, 207 aa, Homo sapiens; identical to SEQ ID NO: 761695

SEQ ID NO: 761697 - protein, 1347 aa, Homo sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 761698 - protein, 56 aa, Homo sapiens
MAEGKASRESEEESVSLTVEEREALGGMDRYAPPSPAWLAGDTLREGLDADAPMVD

SEQ ID NO: 761699 - protein, 121 aa, Homo sapiens
KVGYRRGTWKFVVSMKSCAVSLTTAAVAFGDEAKKMAEGKASRESEEESVSLTVEEREALGGMDRYAPPSPAWLAGDTLREGLDADAPMVDDGVILSLALTNLSLSLLDSGRSKSLAFSDH

SEQ ID NO: 761700 - protein, 121 aa, Homo sapiens
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQYRRLLVQILQK

SEQ ID NO: 761701 - protein, 121 aa, Homo sapiens; identical to SEQ ID NO: 761700

SEQ ID NO: 761702 - protein, 200 aa, Homo sapiens
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 761703 - protein, 149 aa, Homo sapiens
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLGILITLMTFSIIELFISLPFSILGCHSEDCDCEQCC

SEQ ID NO: 761704 - protein, 126 aa, Homo sapiens
DLKHVTYLRVSGRKESLKHGCGKHFRMSSHHYDYKKYGKGLRHMIGGFSLHQRIHSGLKGNKKDVCGKDFSLSSHHQRGQSLHTVGVSFKCSDCGRTFSHSSHLAYHQRLHTQEKAFKCRVCGKAF

SEQ ID NO: 761705 - protein, 560 aa, Homo sapiens
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 761706 - protein, 560 aa, Homo sapiens; identical to SEQ ID NO: 761705

SEQ ID NO: 761707 - protein, 135 aa, Homo sapiens
GPSTRSKLPTLFCIFQIGLTNYSSPPFQGLILTSVSDGKWGFQVPDSVPSLSLVPSAVKSSFLPNCLSGVVKLQTDSFKDTQIPLKVPSPPVLPQWFQISPFRALFEWTVRPLTLSCGFEAPTPPAFLYLQGLSG

SEQ ID NO: 761708 - protein, 560 aa, Homo sapiens; identical to SEQ ID NO: 761705

SEQ ID NO: 761709 - protein, 560 aa, Homo sapiens; identical to SEQ ID NO: 761705

SEQ ID NO: 761710 - protein, 560 aa, Homo sapiens; identical to SEQ ID NO: 761705

SEQ ID NO: 761711 - protein, 142 aa, Homo sapiens
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPAELGFLHHH

SEQ ID NO: 761712 - protein, 323 aa, Homo sapiens
MLRPLPTPLSPPHPQLPSSQWGSLLRWWGAPREGAAGGLPVRHPWGACPFKHESYHQRSPSLLLALPAWCRVLETFLELIQQPSCKVVLGTALLLGGGGLMLWVQRKRRRKETSECPSDKDKSPESHKAKNESWIKSHFSRLSEEKLALDNNASASGNATQTESGSEEVSSTVHIETFTTRHGEVGSALHRESFTSRQKTSGPSVIQEIHQESGKAPSTDDATWAAVAACTKEIDTQGRHLAHSMLQRAIAYQHSGHLESKDINQEELRALEEVEMKLQKNFLTQRENTIAGANHTHTFYGHSHHSHHGHPSHQSHSLPNRRH

SEQ ID NO: 761713 - protein, 290 aa, Homo sapiens
MLTCKALYGQRDGACPFKHESYHQRSPSLLLALPAWCRVLETFLELIQQPSCKVVLGTALLLGGGGLMLWVQRKRRRKETSECPSDKDKSPESHKAKNESWIKSHFSRLSEEKLALDNNASASGNATQTESGSEEVSSTVHIETFTTRHGEVGSALHRESFTSRQKTSGPSVIQEIHQESGKAPSTDDATWAAVAACTKEIDTQGRHLAHSMLQRAIAYQHSGHLESKDINQEELRALEEVEMKLQKNFLTQRENTIAGANHTHTFYGHSHHSHHGHPSHQSHSLPNRRH

SEQ ID NO: 761714 - protein, 97 aa, Homo sapiens
AWADAWDAVTHTHTHILLHMFPCMCVHSDRASPTHLYPTPSTSLPPCTSPQQHTQPPAPPAPRPHQGPSLWPSVLVPELCVKFGPQSGPLGLPCAAV

SEQ ID NO: 761715 - protein, 679 aa, Homo sapiens
QITCAQEFDISLANMVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPGGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761716 - protein, 661 aa, Homo sapiens
GAAPRGGSGAPGRASPQPREPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPSGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761717 - protein, 175 aa, Homo sapiens [sequence omitted]

SEQ ID NO: 761718 - protein, 611 aa, Homo sapiens
RASVRPGPGHVRVRTPPLSPLPFRPWPLCPAARRTMGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTSPTWPPLGGPSPDPSAAELTPL

SEQ ID NO: 761719 - protein, 611 aa, Homo sapiens; identical to SEQ ID NO: 761718

SEQ ID NO: 761720 - protein, 611 aa, Homo sapiens; identical to SEQ ID NO: 761718

SEQ ID NO: 761721 - protein, 331 aa, Homo sapiens
GAAPRGGSGAPGRASPQPREPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTSPTWPPLGGPSPDPSAAELTPL

SEQ ID NO: 761722 - protein, 611 aa, Homo sapiens; identical to SEQ ID NO: 761718

SEQ ID NO: 761723 - protein, 256 aa, Homo sapiens
MKDSSFPSLVQSPRSPGSCGLSGWGWGCPRVASAGSACSCNSAVPARRTQEACRRELIGGRSTIFTDVQGQWGAPGTVNEGNSACPPTLRVTVAAWLSLLFVLCRVCAASVPSLVRLRWGPQCSGPWGAWAPPWAARVSQPGAGPGRGAEAQLLPAASIQWPCHQAPHLLLVLALVTSQGPSRCRGFCLAGPCQGGPGGLLILFCHWNVPLQFSSLFFFFGDGVSLLLPRLECSGSISGHCNLRLPGSSDRPALGS

SEQ ID NO: 761724 - protein, 199 aa, Homo sapiens [sequence omitted]

SEQ ID NO: 761725 - protein, 199 aa, Homo sapiens [sequence omitted]

SEQ ID NO: 761726 - protein, 141 aa, Homo sapiens
WVSRGSLRDCVAPGQHGPHTQLPAHPGQPPLPLVHRHADALTRTHTQMHAHLHMLTHTFTHAHSRSHMLSRIHTRTYSCTCSHACVCTRTEHLPRTSTPPQAPLSPHAPLPNNTHSPLHRPPPAPTKAPASGHQSWCQSFA

SEQ ID NO: 761727 - protein, 34 aa, Homo sapiens
MEEPSYGSWRGPSEPLSALQVDRVSYLLQEIYGI

SEQ ID NO: 761728 - protein, 941 aa, Homo sapiens
RASVRPGPGHVRVRTPPLSPLPFRPWPLCPAARRTMGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPSGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761729 - protein, 750 aa, Homo sapiens
PPSGRRCLVHSVLNGAQAGVQWRDLGSLQPPPPSRLPWPPKVPRVQPLPSRHPVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPGGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761730 - protein, 585 aa, Homo sapiens
SWPRAWTGLKDTGDRAPGFFRPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPGGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761731 - protein, 623 aa, Homo sapiens
GILLLLIFFYILLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDEYSRYVTFQTRFGGSDARPWREEPSPALWRGFLLVFGSSSASASSQGPWIPNPELSSGCCTFPQKVASWGVLTFGARGLSIWTRRPVRLFFQPGGALEQSQPRQGDRHSPGAPEPLSTAGGRSLRDEGSTVEGTPGRHGVSVPRGEAWAWPCSGWSHHEFASVLQQTRLDAQQVHSRVPVMALTIHGERMRPDWESPWITSSQAQSLSLGGSPSSRGPLVPRGEYLASCPEGVRSHSHLLPRSLLPLSAWPPWAWHHHGPGTQSLVGCLCAMSPLLPTHLSLPVLEPSGTPALKDRRPCEVGIPHPPPRGALYQGGPGECFTEGGSVQAVVRTYKPGTLGDRGDRSLEPRNSRSV

SEQ ID NO: 761732 - protein, 611 aa, Homo sapiens; identical to SEQ ID NO: 761718

SEQ ID NO: 761733 - protein, 256 aa, Homo sapiens; identical to SEQ ID NO: 761723

SEQ ID NO: 761734 - protein, 611 aa, Homo sapiens; identical to SEQ ID NO: 761718

SEQ ID NO: 761735 - protein, 336 aa, Homo sapiens
RASVRPGPGHVRVRTPPLSPLPFRPWPLCPAARRTMGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVSHQRKYDVLELKDTHIQSLTRILMHRHTLIHTHIYSYTLIHTHTHSLAHIYGHTYIPS

SEQ ID NO: 761736 - protein, 139 aa, Homo sapiens
DCPVDLIPALYSVGARQKRQGYSKKEWPISGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPVITS

SEQ ID NO: 761737 - protein, 70 aa, Homo sapiens
AAYKQTKAQRARTMALYNPIPVRQNCFTVNRSLFIFGEDNIVRKYAKKLIDWPYPFLPTITPSPPLHFFG

SEQ ID NO: 761738 - protein, 1259 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLSPSQTMHPCTCT

SEQ ID NO: 761739 - protein, 503 aa, Homo sapiens
AVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQVTIASSQPAFPALTGLKRALWLRVG

SEQ ID NO: 761740 - protein, 537 aa, Homo sapiens
AVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLR

SEQ ID NO: 761741 - protein, 458 aa, Homo sapiens
AVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQVTIASSQPAFPALTGLKRALWLRVG

SEQ ID NO: 761742 - protein, 127 aa, Homo sapiens
RPPPTLPPSKPKPVQGLCPHGKPRDKGRSCKRSSGHGSGENGSQRPVTVDSSKARTSLDALKISIRQLKWKEVRPGPTRPRGHSGVDRTTSEVSARPRSGRRARAELLRCTTLGPACQPQSAHPSRP

SEQ ID NO: 761743 - protein, 236 aa, Homo sapiens
MEYVPGCELFSYLRNRGLFYSAEIICAILHSKEIIYRDLKPENILLDRDGHIKLTDFGFAKKLVDRTWTLCGIPEYLAPEVIQSEGHGRAVDWWALSILIFEMLSGFPPFVCVCVCVCVCVCVCDNMFGIYQKILADKIDFPRHLDFHVKDLIKKLLVVDRTRWLGNMKNGANDVKRHRWFRSVDWEAVPQRKLKPPIVPKIAREGDTSNFGTYPENDWDTAATVPQKGLEIFKNF

SEQ ID NO: 761744 - protein, 309 aa, Homo sapiens
SLGVEGAGSRREDLRPGTMAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 761745 - protein, 107 aa, Homo sapiens
QNQVIRERERERVPYRSCPFCDLALEARPHLFHNILVVTHQPNSAWGETSQGHEKRELGLMRAIVESGSHTSLLSIFISLSATQNFCPGLVWLPHPVLSNLPVHPLF

SEQ ID NO: 761746 - protein, 127 aa, Homo sapiens [sequence omitted]

SEQ ID NO: 761747 - protein, 109 aa, Homo sapiens [sequence omitted]

SEQ ID NO: 761748 - protein, 188 aa, Homo sapiens
EGRPGAADAGTLARSLPPSLRRYQMMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRA

SEQ ID NO: 761749 - protein, 215 aa, Homo sapiens [sequence omitted]

SEQ ID NO: 761750 - protein, 224 aa, Homo sapiens
EGRPGAADAGTLARSLPPSLRRYQMMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGVREKENLVQAFKTALPSLELKLQLK

SEQ ID NO: 761751 - protein, 136 aa, Homo sapiens
MCCAVSEQRLTCADQMMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMGNYPIVLLIENADDLQ

SEQ ID NO: 761752 - protein, 136 aa, Homo sapiens; identical to SEQ ID NO: 761751

SEQ ID NO: 761753 - protein, 112 aa, Homo sapiens
MMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMETSNICC

SEQ ID NO: 761754 - protein, 200 aa, Homo sapiens
MMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGVREKENLVQAFKTALPSLELKLQLK

SEQ ID NO: 761755 - protein, 136 aa, Homo sapiens; identical to SEQ ID NO: 761751

SEQ ID NO: 761756 - protein, 200 aa, Homo sapiens; identical to SEQ ID NO: 761754

SEQ ID NO: 761757 - protein, 188 aa, Homo sapiens [sequence omitted]

SEQ ID NO: 761758 - protein, 178 aa, Homo sapiens
MCCAVSEQRLTCADQMMLFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLR

SEQ ID NO: 761759 - protein, 136 aa, Homo sapiens; identical to SEQ ID NO: 761751

SEQ ID NO: 761760 - protein, 106 aa, Homo sapiens
SDTTRSQASRHEEHVQNIRRFHESLHLQGEAPLPCDDKLTTSPLSSQTSILTSLSPQTQTAISQHQESCRDHLGPGASSLDPGSQCILEKSSNLVLQVSSLITGSY

SEQ ID NO: 761761 - protein, 521 aa, Homo sapiens
SDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLASQSRRENHKGPPIDSSDIRQRQVTTGSETSTKQSLLLPGPIVVPNFFLPPQQLEASLRMLSLSATLPPAATTDQDKSEATRGALSQRPCRPRPNSLPLNLPEEETLRIARIFSSQYSQKD

SEQ ID NO: 761762 - protein, 131 aa, Homo sapiens
SDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITGSY

SEQ ID NO: 761763 - protein, 440 aa, Homo sapiens
SDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLAPEEGTLGAPALDREGDMSQSNTCPAWAFAPGPGLQHFTL

SEQ ID NO: 761764 - protein, 409 aa, Homo sapiens
MALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRDVEVVAAPVEAMAPPVEAGAAPMETQFPHVEARAASMETTEKLERILLQLLGDADQEKYTYWGQKEGDLRSVETATSYFSGTTNPWSRASSEPLPVQLPASYSYSYSSPFSSFSDIPTISPPQATVTAPVPPQLPSDWEAFDTSLWSDGGPHRIDHQEHPRDRRYSEPHQQRPPVYRRPGDWDCPWCNAVNFSRRDTCFDCGKGIWLQKPH

SEQ ID NO: 761765 - protein, 437 aa, Homo sapiens
ERDLPLSSGVLRQRGWPVLPLALAEEAIMALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRDVEVVAAPVEAMAPPVEAGAAPMETQFPHVEARAASMETTEKLERILLQLLGDADQEKYTYWGQKEGDLRSVETATSYFSGTTNPWSRASSEPLPVQLPASYSYSYSSPFSSFSDIPTISPPQATVTAPVPPQLPSDWEAFDTSLWSDGGPHRIDHQEHPRDRRYSEPHQQRPPVYRRPGDWDCPWCNAVNFSRRDTCFDCGKGIWLQKPH

SEQ ID NO: 761766 - protein, 149 aa, Homo sapiens
VCAAVVLLPDGQASVVPHASENLVSQVPQGHLQSMPTGNMRASQELHDLMAARRSKLVQEEPRNPNCQGSCKSQRPMFPPIHKSEKSRKPNLEKHEERLEGLRTPQLTPVRKTEDTHQDEGVQLLPSKKQPPSVSHFGENIKQFFQWIF

SEQ ID NO: 761767 - protein, 47 aa, Homo sapiens
MGHFRNPHFLVMLTQDSFRTTWYPSSGLPLHCTHVAPWHLSHHKVTD

SEQ ID NO: 761768 - protein, 115 aa, Homo sapiens
RVPVLGLVILGKSQAVPCPPSGYEPRMLIFFPWLLHDFVEFPEYVWGPPASHSPQPCGSRAGCQAQSAGPRAPEVGGCVPELPLWALPGAGRDHTGGRNSGSPGLGHTSLVLVIY

SEQ ID NO: 761769 - protein, 206 aa, Homo sapiens
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 761770 - protein, 232 aa, Homo sapiens
QAGTGPGFYGVAELEVGARHGGACGPMALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 761771 - protein, 206 aa, Homo sapiens; identical to SEQ ID NO: 761769

SEQ ID NO: 761772 - protein, 227 aa, Homo sapiens
SNSRGYVRGLGGSRAGGGCPARRGLRTNGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 761773 - protein, 206 aa, Homo sapiens; identical to SEQ ID NO: 761769

SEQ ID NO: 761774 - protein, 235 aa, Homo sapiens
MALPCTLGLGMLLALPGALGSGGSAEDSVGSSSVTVVLLLLLLLLLATGLALAWRRLSRDSGGTSQSNPVTQSYVLPAAVLVGLHRWALCLWGQTPPGVRLVLQVSLKGRELVCVQEQFDPVDGVSQGRDMPGEHQDLIEPACEIVLDACRARPVGERGEQQCGEASSPEQVPVRAEEARDSDTEGDLVLGSPGPASAGGSAEALLSDLHAFAGSAAWDDSARAAGGQGLHVTAL

SEQ ID NO: 761775 - protein, 302 aa, Homo sapiens
GAGDVCAAGPMALPCTLGLGMLLALPGALGSGGSAEDSVGSSSVTVVLLLLLLLLLATGLALAWRRLSRDSGGYYHPARLGAALWGRTRRPWLLGAPGPPPQGGSGLGFGKGAPPGSAVEGFGGGFPAKNTNLTPFERPNQGGGGVDDSEARGTFIRHNLSGGICVGTFANGRLNPLCGGNRGRKGQRGHNRFLFLGGGSSGEGGGAVFPPESAPPPKSVDVRPECGGFFPPPAVWFLRARGGGLLLGDGGELGPHGNRHMCKTQPGTGGGDTLAFPPAAPPAMVNPRGGNGRQGWGAKGWL

SEQ ID NO: 761776 - protein, 206 aa, Homo sapiens; identical to SEQ ID NO: 761769

SEQ ID NO: 761777 - protein, 206 aa, Homo sapiens; identical to SEQ ID NO: 761769

SEQ ID NO: 761778 - protein, 206 aa, Homo sapiens; identical to SEQ ID NO: 761769

SEQ ID NO: 761779 - protein, 216 aa, Homo sapiens
GAGDVCAAGPMALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 761780 - protein, 86 aa, Homo sapiens
SNSRGYVRGLGGSRAGGGCPARRGLRTNGSALHLRARDAAGPARGLGLGWQRGGQRGLQLCHRCPAAAAAPTAGHWPSTGLAPPQP

SEQ ID NO: 761781 - protein, 137 aa, Homo sapiens [sequence omitted]

SEQ ID NO: 761782 - protein, 954 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 761783 - protein, 937 aa, Homo sapiens [sequence omitted]

SEQ ID NO: 761784 - protein, 709 aa, Homo sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTVSPGLETDLEADMSRCSFP

SEQ ID NO: 761785 - protein, 954 aa, Homo sapiens; identical to SEQ ID NO: 761782

SEQ ID NO: 761786 - protein, 954 aa, Homo sapiens; identical to SEQ ID NO: 761782

SEQ ID NO: 761787 - protein, 752 aa, Homo sapiens [sequence omitted]

SEQ ID NO: 761788 - protein, 1375 aa, Homo sapiens
PEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQEMLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQVTLGKIIFKK

SEQ ID NO: 761789 - protein, 1042 aa, Homo sapiens
PEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQEMLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEIVLENQQQNTDKVHKYRLDILG

SEQ ID NO: 761790 - protein, 77 aa, Homo sapiens
FRISAPMLGMVWLHQHPCETLRDTRSLQARIRFCIFTGLSDSHLLEQEKQCPKKFRQFTHQNSRELLEVGNEHLGRG

SEQ ID NO: 761791 - protein, 81 aa, Homo sapiens
ASKTVRLQQHGDRVQKEVAEALEERHSVIQGHPDACAAVLSKSTGRCSFVSTPDKTHGDCCQCCVCYNTRDPHMAVLDSNQ

SEQ ID NO: 761792 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 761793 - protein, 393 aa, Homo sapiens
CILLCWCTRVLTCILGIEDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 761794 - protein, 286 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPLPPPGWLLPSCLQLKVLYKTKKT

SEQ ID NO: 761795 - protein, 290 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEHSREGL

SEQ ID NO: 761796 - protein, 467 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 761797 - protein, 327 aa, Homo sapiens
MVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 761798 - protein, 467 aa, Homo sapiens; identical to SEQ ID NO: 761796

SEQ ID NO: 761799 - protein, 372 aa, Homo sapiens
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 761800 - protein, 350 aa, Homo sapiens
MLGSVKMEAHDLAEWSYYPEAGEVYSPVTPVPTMAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAPGKMLTLSEIYQWIMDLFPYYRENQQRWQNSIRHSLSFNDCFVKVARSPDKPGKGSYWALHPSSGNMFENGCYLRRQKRFKLEEKVKKGGSGAATTTRNGTGSAASTTTPAATVTSPPQPPPPAPEPEAQGGEDVGALDCGSPASSTPYFTGLELPGELKLDAPYNFNHPFSINNLMSEQTPAPPKLDVGFGGYGAEGGEPGVYYQGLYSRSLLNAS

SEQ ID NO: 761801 - protein, 350 aa, Homo sapiens; identical to SEQ ID NO: 761800

SEQ ID NO: 761802 - protein, 232 aa, Homo sapiens [sequence omitted]

SEQ ID NO: 761803 - protein, 496 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 761804 - protein, 176 aa, Homo sapiens [sequence omitted]

SEQ ID NO: 761805 - protein, 496 aa, Homo sapiens; identical to SEQ ID NO: 761803

SEQ ID NO: 761806 - protein, 539 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSADAGIGSRGNRGLESSVPCSEKLVIGTPTSGGIPESNFPGEMRDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 761807 - protein, 93 aa, Homo sapiens
MSPDATKPSHWCSVAYWEHRTRVGRLYAVYDQAVSIFYDLPQGSGFCLGQLNLEQRSESVRRTRSKIGFGILLSKEPDGVWAYNRGEHPIFVN

SEQ ID NO: 761808 - protein, 680 aa, Homo sapiens
LPSPSAALAAAVRWLQEAAAPPLLLSGTQRGAPLAGRRHPLSLQPAVRCTAWGPGAPASAHEGAPRPPLLPARGGAALGGGGGGLPPLREAGGPGRLREGTMEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLVCPMSKSPYVDPHKSGHEIWEEFSMSFTPAVKEVVEFAKRIPGFRDLSQHDQVNLLKAGTFEVLMVRFASLFDAKERTVTFLSGKKYSVDDLHSMGAGDLLNSMFEFSEKLNALQLSDEEMSLFTAVVLVSADRSGIENVNSVEALQETLIRALRTLIMKNHPNEASIFTKLLLKLPDLRSLNNMHSEELLAFKVHP

SEQ ID NO: 761809 - protein, 230 aa, Homo sapiens
MGGLIKPGGGALNRGGGTTTPVGHLWGRRGTPYTRGGGRNNGGATTTPESYVRRVRGINTQTSGVELVGGSPQARIFAKQKRSWATRAYRIDDLSFAGLRELLRRTKSQKRPRDNEASQDEHEGTTDGKTTRREGNKAKETHPQEASKPPHTEDKARNDELKESDKDRRRIDTKTRGHKAAHKAGEQHTTTRTTNNDDSTSRDPRQTRDQEQTAESTKARRRTHTVTEQA

SEQ ID NO: 761810 - protein, 680 aa, Homo sapiens; identical to SEQ ID NO: 761808

SEQ ID NO: 761811 - protein, 207 aa, Homo sapiens
SGVQSSSAVRLRLLWLPTLHWVERQTGATFRDRVETDSEEDRTHLHAFMSAAIPPPQASAKPFLGPWRQPCVLTARRGGAGTLCAFYTTAGTEVPRSPEPEPGVGRARRTGFLADSHGLTQPPGPMAAPALALVSFEDVVVTFTGEEWGHLDLAQRTLYQEVMLETCRLLVSLGHPVPKPELIYLLEHGQELWTVKRGLSQSTCAGW

SEQ ID NO: 761812 - protein, 133 aa, Homo sapiens
MGAPGPGPEDPVPGGDAGDLQAPGLTGASCSQTRADLSTGTWTGTVDSEERPLPKHLRSFLLTSVEELSSWPWLISPAESRLHFLPSQVYYHLLLICNNITTNPAAENITYLLSPTYGLGVQAQLSWVLSGVS

SEQ ID NO: 761813 - protein, 92 aa, Homo sapiens
SGVQSSSAVRLRLLWLPTLHWVERQTGATFRDRVETDSEEDRTHLHAFMSAAIPPPQASAKPFLGPWRQPCVLTARRGGAANLVCILHDGGD

SEQ ID NO: 761814 - protein, 114 aa, Homo sapiens
VCNPLRYNIIMNSSTFIWVIIVSWVLGFLSEIWPVYATFQLTFCKSSVLDHFYCDRGQLLKVSCEDTLFREFILFLMAVFIIIGSLIPTIVSYTYIISTNLKIPSASGWRKSFS

SEQ ID NO: 761815 - protein, 275 aa, Homo sapiens
NVQGLSAEEIRNGNLKAILGLFFSLSRYKQQQHHQQQYYQSLVELQQRVTHASPPSEASQAKTQQDMQSRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAG

SEQ ID NO: 761816 - protein, 211 aa, Homo sapiens
NVQGLSAEEIRNGNLKAILGLFFSLSRYKQQQHHQQQYYQSLVELQQRVTHASPPSEASQAKTQQDMQSRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGCPDCFTPPAASQFRT

SEQ ID NO: 761817 - protein, 258 aa, Homo sapiens
NVQGLSAEEIRNGNLKAILGLFFSLSRYKQQQHHQQQYYQSLVELQQRVTHASPPSEASQAKTQQDMQSRLPGPSRVPAAGSSSKVQGASNLNRRSQSFNSIDKNKPPNYANGNEKAPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAG

SEQ ID NO: 761818 - protein, 37 aa, Homo sapiens
LASGYSEVLVQFWQPELFLLQGEIREYSSFQGERLTC

SEQ ID NO: 761819 - protein, 325 aa, Homo sapiens
MDGSNVTSFVVEEPTNISTGRNASVGNAHRQIPIVHWVIMSISPVGFVENGILLWFLCFRMRRNPFTVYITHLSIADISLLFCIFILSIDYALDYELSSGHYYTIVTLSVTFLFGYNTGLYLLTAISVERCLSVLYPIWYRCHRPKYQSALVCALLWALSCLVTTMEYVMCIDREEESHSRNDCRAVIIFIAILSFLVFTPLMLVSSTILVVKIRKNTWASHSSKLYIVIMVTIIIFLIFAMPMRLLYLLYYEYWSTFGNLHHISLLFSTINSSANPFIYFFVGSSKKKRFKESLKVVLTRAFKDEMQPRRQKDNCNTVTVETVV

SEQ ID NO: 761820 - protein, 1162 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSLQIIEAKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQLREETSSPAISDLSQILKSQDESAFLESSNEVSVAENQSYKSPSETHDKSLTTVSSSKEVQDSLSVGTLAQKNETVISPFILPPVLTESKKADVSEEQLQKMTEEQTYQAAEKSQAHNEVPNERLVVEHQESLSKTKLQVKKQETSTEQPLTTPDKEPNENLILRHQDSMSKSEMQVKEQRTLKGQRIITHDEEPGKNLVPEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNESVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHAETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTIGKPTYKVLHAAARKSVPHPYF

SEQ ID NO: 761821 - protein, 1162 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSTTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQLREETIYPAISDLSQILKSQDESAFLESSNEVSVAENQSYKSPSETHDKSLTTVSSSKEVQDSLSVGTLAQKNETVISPFILPPVLTESKKADVSEEQLQKMTEEQTYQAAEKSQAHNEVPNERLVVEHQESLSKTKLQVKKQETSTEQPLTTPDKEPNENLILRHQDSMSKSEMQVKEQRTLKGQRIITHDEEPGKNLVPEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNESVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHAETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTIGKPTYKVLHAAARKSVPHPYF

SEQ ID NO: 761822 - protein, 310 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERNRHRGLQHLIHSTNGILKR

SEQ ID NO: 761823 - protein, 446 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSLQIIEAKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQITAQSGRLIEKRC

SEQ ID NO: 761824 - protein, 121 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMGLFPPLEGNLCGHWRFRMAEEPFGKHEP

SEQ ID NO: 761825 - protein, 1028 aa, Homo sapiens
QEEQNILESLFKWFQWQVNQMEEISGVQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSTTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQLREETSSPAISDLSQILKSQDESAFLESSNEVSVAENQSYKSPSETHDKSLTTVSSSKEVQDSLSVGTLAQKNETVISPFILPPVLTESKKADVSEEQLQKMTEEQTYQAAEKSQAHNEVPNERLVVEHQESLSKTKLQVKKQETSTEQPLTTPDKEPNENLILRHQDSMSKSEMQVKEQRTLKGQRIITHDEEPGKNLVPEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNESVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHAETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTIGKPTYKVLHAAARKSVPHPYF

SEQ ID NO: 761826 - protein, 456 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSLQIIEAKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQMLIEFLKYFGKVSQTFREWMGAK

SEQ ID NO: 761827 - protein, 303 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNIWNLFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERKLSLQIIEQRKL

SEQ ID NO: 761828 - protein, 47 aa, Homo sapiens
LQLAELEGEFLVNEFITRQRRRELSDRLNLSDQQVKIWFQNRRMKKK

SEQ ID NO: 761829 - protein, 73 aa, Homo sapiens
VFLGWIALFLENGNFFPSFWKKVRRENPEPESSPKGHRWRHQQDQQGPTLGTDPGTGAREPLSASSRETLTVE

SEQ ID NO: 761830 - protein, 111 aa, Homo sapiens
MPLSALPKDLCEARQKRLVRGPSELPVLFLLLLLTLYVSWLSKLTQLQMPLSHLKSMATISLAFSPPLASITFLEVISFTSVAFFVTSLQVLPELKRPCNCEEKNAAVSWN

SEQ ID NO: 761831 - protein, 118 aa, Homo sapiens [sequence omitted]

SEQ ID NO: 761832 - protein, 306 aa, Homo sapiens
LYSASVSLDTLDAPYEGIPYGISELRCFSPQKNLALGEDLSPGYGQDHDVGAFGTQATLFLEGGAGGRDLELASISQWSLHGTHHRTFFPRLFSLQAPVPPKIYLSMVYKLEGPTDVTVALELTTGDAGSCHIGGISVLNAETSSRHSLRPLRVPPTKLARWVGRCGRQLSGGWVQHCYEVSLRGCLLLDLLVCFSRPPGSREEENFTCRLGEIQVVDAASLLAPLPQVQAVTISHIRWQPSASEREGPPALLQLSCTLHWSFLLSQVRCFRIHCWGGMSDDSPGRELPRPEMPMFLGLAFATSTG

SEQ ID NO: 761833 - protein, 306 aa, Homo sapiens; identical to SEQ ID NO: 761832

SEQ ID NO: 761834 - protein, 355 aa, Homo sapiens
LYSASVSLDTLDAPYEGIPYGISELRCFSPQKNLALGEDLSPGYGQDHDVGAFGTQATLFLEGGAGGRDLELASISQWSLHGTHHRTFFPRLFSLQAPVPPKIYLSMVYKLEGPTDVTVALELTTGDAGSCHIGGISVLNAETSSRHSLRPLRVPPTKLARWVGRCGRQLSGGWVQHCYEVSLRGCLLLDLLVCFSRPPGSREEENFTCRLGEIQVMLPRGARAGLAVCPAGVGVEESGRGNVCVGAPSPRPGRPAVLSLLSCQVVDAASLLAPLPQVQAVTISHIRWQPSASEREGPPALLQLSCTLHWSFLLSQVRCFRIHCWGGMSDDSPGRELPRPEMPMFLGLAFATSTG

SEQ ID NO: 761835 - protein, 372 aa, Homo sapiens
LYSASVSLDTLDAPYEGIPYGISELRCFSPQKNLALGEDLSPGYGQDHDVGAFGTQATLFLEGGAGGRDLELASISQWSLHGTHHRTFFPRLFSLQAPVPPKIYLSMVYKLEGPTDVTVALELTTGDAGSCHIGGISVLNAETSSRHSLRPLRVPPTKLARWVGRCGRQLSGGWVQHCYEVSLRGCLLLDLLVCFSRPPGSREEENFTCRLGEIQVMLPRGARAGLAVCPAGVGVEAAPGRPLLGFSGELGWRSQGGEMCAWGHPLPAPGRPAVLSLLSCQVVDAASLLAPLPQVQAVTISHIRWQPSASEREGPPALLQLSCTLHWSFLLSQVRCFRIHCWGGMSDDSPGRELPRPEMPMFLGLAFATSTG

SEQ ID NO: 761836 - protein, 129 aa, Homo sapiens
METGNQAVGSQRWSLRGEWRAFCFCLVPPHGTWFPGENERRGEVENRTFHKGYFLIGCKMLMPRMMIFFPADETIRKGLRLWQVGFGAGAETFLSMRTSYSSSWGGAACGMAGEDALENRPPSVEGPFP

SEQ ID NO: 761837 - protein, 527 aa, Homo sapiens
SVMEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHGGSSLLVRGVIPPEVGNVAVRWVSDGGRWAHQLLPSHVVAMELDRWGSGGQNKDRGQTQMGFLKL

SEQ ID NO: 761838 - protein, 35 aa, Homo sapiens
MRKIPAAVLMPGSVDAGWWKGWPSVGVTLELSLWG

SEQ ID NO: 761839 - protein, 379 aa, Homo sapiens
SVMEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGCSVFPGVGNLLCC

SEQ ID NO: 761840 - protein, 131 aa, Homo sapiens
SNSQSSCEWRWSLMVVLIVDVSWLTLHKTNWREEHLERMLGQAGERRADVYVGVDVFARGNVVGGRFDTDKVGGGFRPRASGPVPPLGPHFLMDLPFPSAPQRNDSSCSSQSGDPVALRNRCPAPAKLCPH

SEQ ID NO: 761841 - protein, 484 aa, Homo sapiens
SVMEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHPALVLPPLTSPLLPNPLLGRDE

SEQ ID NO: 761842 - protein, 306 aa, Homo sapiens; identical to SEQ ID NO: 761832

SEQ ID NO: 761843 - protein, 179 aa, Homo sapiens
TAQPQPVGAQPLPPCPCSSADRLSRALFWRACGTTGVMPSSLQSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHPALVLPPLTSPLLPNPLLGRDE

SEQ ID NO: 761844 - protein, 306 aa, Homo sapiens; identical to SEQ ID NO: 761832

SEQ ID NO: 761845 - protein, 408 aa, Homo sapiens
SVMEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKVGGGFRPRASGPVPPLGPHFLMDLPFPSAPQRNDSSCSSQSGDPVALRNRCPAPAKLCPH

SEQ ID NO: 761846 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 761847 - protein, 193 aa, Homo sapiens; identical to SEQ ID NO: 761846

SEQ ID NO: 761848 - protein, 104 aa, Homo sapiens
NPVPPGPQQDPRLYWQGGPALGRSFLHGPELDKGQLRIHRDGIYMVHIQVTLAICSSTTASRHHPTTLAVGICSPASRSISLLRLSFHQGCTIASHGCAPDHCC

SEQ ID NO: 761849 - protein, 589 aa, Homo sapiens
MSVSVHETRKSRSSTGSMNVTLFHKASHPDCVLAHLNTLRKHCMFTDVTLWAGDRAFPCHRAVLAASSRYFEAMFSHGLRESRDDTVNFQDNLHPEVLELLLDFAYSSRIAINEENAESLLEAGDMLQFHDVRDAAAEFLEKNLFPSNCLGMMLLSDAHQCRRLYEFSWRMCLVHFETVRQSEDFNSLSKDTLLDLISSDELETEDERVVFETILQWVKHDLEPRKVHLPELLRSVRLALLPSDCLQEAISSEALLMADERTKLIMDEALRCKTRILQNDGVVTSPCARPRKAGHTLLILGGQTFMCDKIYQVDHKAKEIIPKADLPSPRKEFSASAIGCKVYVTGGRGSENGVSKDVWVYDTVHEEWSKAAPMLIARFGHGSAELENCLYVVGGHTSLAGVFPASPSVSLKQVEKYDPGANKWMMVAPLRDGVSNAAVVSAKLKLFVFGGTSIHRDMVSKVQCYDPSENRWTIKAECPQPWRYTAAAVLGSQIFIMGGDTEFTAASAYRFDCETNQWTRIGDMTAKRMSCHALASGNKLYVVGGYFGTQRCKTLDCYDPTSDTWNCITTVPYSLIPTAFVSTWKHLPA

SEQ ID NO: 761850 - protein, 199 aa, Homo sapiens
GSLIKLIPLPSPFPASPSVSLKQVEKYDPGANKWMMVAPLRDGVSNAAVVSAKLKLFVFGGTSIHRDMVSKVQCYDPSENRWTIKAECPQPWRYTAAAVLGSQIFIMGGDTEFTAASAYRFDCETNQWTRIGDMTAKRMSCHALASGNKLYVVGGYFGTQRCKTLDCYDPTSDTWNCITTVPYSLIPTAFVSTWKHLPA

SEQ ID NO: 761851 - protein, 589 aa, Homo sapiens; identical to SEQ ID NO: 761849

SEQ ID NO: 761852 - protein, 589 aa, Homo sapiens; identical to SEQ ID NO: 761849

SEQ ID NO: 761853 - protein, 261 aa, Homo sapiens
LCIGGSLAASLASTCWVPVASLPHLWQPKMSSGEQHRSVENHRPRRAPCVEGTIGLPQKLLGEPLSSGILLSLWAGTVLRSSFDVYVLPPLVHLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEN

SEQ ID NO: 761854 - protein, 219 aa, Homo sapiens
RQYEALVELGGFLAPEEEAGSPSLHVRDLTVEMAAQKINEGLEHLAKAEKYLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEN

SEQ ID NO: 761855 - protein, 140 aa, Homo sapiens
GLVRPAYISSTTPSAAAARLLQLQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 761856 - protein, 219 aa, Homo sapiens
VPSYLPDLPGIANDLMYIADLGPGIAPSAPGTIPELPTFHTEVAEPLKTYKMGYYTPPPPPPPPPPAPEVLASAPPLPPSTAAPVGQGARQDDSSSSASPSVQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 761857 - protein, 219 aa, Homo sapiens; identical to SEQ ID NO: 761856

SEQ ID NO: 761858 - protein, 219 aa, Homo sapiens; identical to SEQ ID NO: 761856

SEQ ID NO: 761859 - protein, 219 aa, Homo sapiens; identical to SEQ ID NO: 761856

SEQ ID NO: 761860 - protein, 115 aa, Homo sapiens
PRCGAQPARKLSPVRSLQTLCFVLGEGVVFVFLVTALLRYNSRTVRFTPFNMYNSVVLTILTELCSHHHFLQNIFITPKINPIPISIHSPFSSPPAPDNLLASSWICLLWTFPIN

SEQ ID NO: 761861 - protein, 114 aa, Homo sapiens
ICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALS

SEQ ID NO: 761862 - protein, 289 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 761863 - protein, 289 aa, Homo sapiens; identical to SEQ ID NO: 761862

SEQ ID NO: 761864 - protein, 188 aa, Homo sapiens
RARYPAKAQYPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 761865 - protein, 191 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVNTALPCTRPA

SEQ ID NO: 761866 - protein, 289 aa, Homo sapiens; identical to SEQ ID NO: 761862

SEQ ID NO: 761867 - protein, 96 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 761868 - protein, 121 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLRTERTLLGLEVSLAHHGGFSAYLICASLDLSN

SEQ ID NO: 761869 - protein, 96 aa, Homo sapiens; identical to SEQ ID NO: 761867

SEQ ID NO: 761870 - protein, 2484 aa, Homo sapiens
AAAAAAAEEATEKIPALRPALLWALLALWLCCATPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDHMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 761871 - protein, 127 aa, Homo sapiens
TLLRMISLFSYNLSLYNYLEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGN

SEQ ID NO: 761872 - protein, 288 aa, Homo sapiens
AAAAAAAEEATEKIPALRPALLWALLALWLCCATPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 761873 - protein, 325 aa, Homo sapiens
AAAAAAAEEATEKIPALRPALLWALLALWLCCATPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPGKELPSVPGLGDKPLAQEVVGVAQLLFLGSARKKGSENFVWGGLLVREEFYGPTVVHKLSRG

SEQ ID NO: 761874 - protein, 78 aa, Homo sapiens
EDPMPITSKDTYNMLKTKDEPQRETLKAIHYALNCCGLAGGWNRIQAAESDELLSHKDPVFIQISLVQKQKKENCRGE

SEQ ID NO: 761875 - protein, 288 aa, Homo sapiens; identical to SEQ ID NO: 761872

SEQ ID NO: 761876 - protein, 325 aa, Homo sapiens; identical to SEQ ID NO: 761873

SEQ ID NO: 761877 - protein, 217 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 761878 - protein, 122 aa, Homo sapiens
MYEAGGAMPLAGMSGQGASPRGGGPLILLDLNDENSNQSFHFGPGPSPASMAGRTVRAETRSRAKDDIKKVMATIEKVRRWEKRWVTVGDTSLRIFKWVPVVDPQEEERRRAGGGAERSRDP

SEQ ID NO: 761879 - protein, 198 aa, Homo sapiens
SEVGAAEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 761880 - protein, 154 aa, Homo sapiens
MYCCIWLLSLKISSCDLSMLLCVAGHVNPVAVSMCMVVSRASFIFHSVDGLFPVWGCYERALNIPMHPLDAHTYTFLLGVDSLGVELLDHRGGICSASLENCQFSKMSLPIYTPPEIQERSSRSTFSPPHGAVFFTLAILVVETHSYSQRIPGA

SEQ ID NO: 761881 - protein, 217 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERGRTRYLPGALSSKSCLLQSLTYQLIPIPAPRLVHPPQGAFRLLQNLPVATVSFLWSLRIYTDISLSEIFM

SEQ ID NO: 761882 - protein, 70 aa, Homo sapiens
GSPSGGALRVSVSPMLTKEEPVPELLEAEAPEAYPVFEPVPPVPEAAQGDTEDSEGAPPLKRICPNAPDP

SEQ ID NO: 761883 - protein, 338 aa, Homo sapiens
TREGAANSRWDGRPRARRPGLARSLSPPDGRRPRRGLGPGPSPASMAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAETMEMMLDKKQIQAIFLFELKMGHKAVETLRNINNTLGPGTANEHIVQWWFKKFCKEDKSLEDEKHSVWPSEVDNDQLKALIEADPVKTTQEVAQELNHRPFYGRLAFEANWKGEKAQ

SEQ ID NO: 761884 - protein, 132 aa, Homo sapiens
KRKQQNKETQHRVDIYRKRPSTKKGTEPSPGGTPQPSRPVSPAGPPEGVPEEAQPPRLGQERGRTRYLPGALSSKSCLLQSLTYQLIPIPAPRLVHPPQGAFRLLQNLPVATVSFLWSLRIYTDISLSEIFM

SEQ ID NO: 761885 - protein, 163 aa, Homo sapiens [sequence omitted]

SEQ ID NO: 761886 - protein, 207 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPALILLSATEYPQCCPTRTLVQNCCTLRPWSLPCLCARPCSCVAHVATVHFILPPPPCA

SEQ ID NO: 761887 - protein, 216 aa, Homo sapiens
MGAVMGTFSSLQTKQRRPSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 761888 - protein, 267 aa, Homo sapiens
GFRGASVTQGSFTQAGSKFLGCTRWALSLLGADSRAWLPSATMSGCSKRCKLGFVKFAQTIFKLITGTLSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 761889 - protein, 201 aa, Homo sapiens
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRG

SEQ ID NO: 761890 - protein, 107 aa, Homo sapiens
GGGVIMATSELSCEVSEENCERREAFWAEWKDLTLSTRPEEGKEEREDTPIQLQELLALETALGGQCVDRQEVAEITKQLPPVVPVSKPGALRRSLSRSMSQEAQRG

SEQ ID NO: 761891 - protein, 172 aa, Homo sapiens
GGGVIMATSELSCEVSEENCERREAFWAEWKDLTLSTRPEEGCSLHEEDTQRHETYHQQGQCQVLVQRSPWLMMRMGILGRGLQEYQLPYQRVLPLPIFTPAKMGATKEEREDTPIQLQELLALETALGGQCVDRQEVAEITKQLPPVVPVSKPGALRRSLSRSMSQEAQRG

SEQ ID NO: 761892 - protein, 172 aa, Homo sapiens; identical to SEQ ID NO: 761891

SEQ ID NO: 761893 - protein, 227 aa, Homo sapiens
GGGVIMATSELSCEVSEENCERREAFWAEWKDLTLSTRPEEGCSLHEEDTQRHETYHQQGQCQVLVQRSPWLMMRMGILGRGLQEYQLPYQRVLPLPIFTPAKMGATEGEVKRAEARMVGPPAPSVSAAINAQSCARENKMTSPYDEKTLRWLGHARSTSEKAFVKTQFGGGRARPVRQQVNMGHNGPKKNGARKRRGSTQKNAGVTGVGQPKGEARQGSSRSKDDN

SEQ ID NO: 761894 - protein, 64 aa, Homo sapiens
PRWRPARKPEGPPRACQEIRPRSISFTLFLSALSTKLTLCLLSYQRRYISLVHDLHILPTNERI

SEQ ID NO: 761895 - protein, 257 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQV

SEQ ID NO: 761896 - protein, 433 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYSFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 761897 - protein, 340 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDGKKKLLLGTQKNLRIFLKPLG

SEQ ID NO: 761898 - protein, 455 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 761899 - protein, 468 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 761900 - protein, 442 aa, Homo sapiens
MLRWTQRAECSVSPSHPQLQLPSKEGIALSLLGPLTALTRSEWHRQSSGTATDGKTRGSLGDLGRAAQTRGGGSQHPQPAPAHSHPYPGSPPRLSGPHLYGRKPRKQEVASRGGREGRGLRHHLSCGPRRDGGHRGGRGGCARGRARAAGATPAPAAPTAAPAAAQGRDGGRGWGSRGVPHGRRVCEPGLALLCPVQHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 761901 - protein, 450 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPTSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 761902 - protein, 186 aa, Homo sapiens
MASAKLGNGDRWEDAWEPGGSRESRANSRRTQPAPAASTRTLPPIPRAARQDSLARTSMVGNPENRKWPREGEGRGGASATTSAADRGEMAATEGVGEAAQGGEPGQPAQPPPQPHPPPPQQQHKEEMAAEAGEAVASPMDDGFVSLDSPSYVLYRDRAEWADIDPVPQNDGPNPVVQIPIFLFRG

SEQ ID NO: 761903 - protein, 179 aa, Homo sapiens
MLELVFLADKDLRTKGFSLESCRSMVNLMDRDGNGKLGLVEFNILWNRIRNYLVVVPTHLSHAGAGRAGGKGRVTQPGPHPLPPPQSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761904 - protein, 105 aa, Homo sapiens
MCLSPGIDMSTSLARVGLLSPLLPATIVHLLRAELCGPCLCQPWARDGLPGPHPLPSQEGSFRLFLPRDSPGFPQHPDVSPLPTSEATHSAPPAWPCLQTINYNH

SEQ ID NO: 761905 - protein, 714 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761906 - protein, 714 aa, Homo sapiens; identical to SEQ ID NO: 761905

SEQ ID NO: 761907 - protein, 714 aa, Homo sapiens; identical to SEQ ID NO: 761905

SEQ ID NO: 761908 - protein, 714 aa, Homo sapiens; identical to SEQ ID NO: 761905

SEQ ID NO: 761909 - protein, 714 aa, Homo sapiens; identical to SEQ ID NO: 761905

SEQ ID NO: 761910 - protein, 714 aa, Homo sapiens; identical to SEQ ID NO: 761905

SEQ ID NO: 761911 - protein, 755 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKSEYAAEEGNSSFQLPLGVGAHDCLLRGSCLMPECCPGAAHRVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761912 - protein, 755 aa, Homo sapiens; identical to SEQ ID NO: 761911

SEQ ID NO: 761913 - protein, 562 aa, Homo sapiens
SVGNRTLGLTPNSKGPGDKLRWFQMTTSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761914 - protein, 581 aa, Homo sapiens
MELRSGDSKAGTHRAPPPQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761915 - protein, 421 aa, Homo sapiens [sequence omitted]

SEQ ID NO: 761916 - protein, 386 aa, Homo sapiens
MEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761917 - protein, 635 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCQARKAAFACSCLGTAPGFPSILMCPLSPLQRPPTQHHRPGLACRL

SEQ ID NO: 761918 - protein, 255 aa, Homo sapiens [sequence omitted]

SEQ ID NO: 761919 - protein, 147 aa, Homo sapiens
GVLEDPNQFNKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761920 - protein, 121 aa, Homo sapiens
MKHIDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761921 - protein, 117 aa, Homo sapiens
LADSRGSLIRIRFYILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761922 - protein, 83 aa, Homo sapiens
SRSGERDVMRMAIESAGFKLNKKLYELIITRYSEPDLAVDFDNFVCCLVRLETMFRFFKTLDTDLDGVVTFDLFKWLQLTMFA

SEQ ID NO: 761923 - protein, 332 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYASVCDVFLPSLL

SEQ ID NO: 761924 - protein, 305 aa, Homo sapiens [sequence omitted]

SEQ ID NO: 761925 - protein, 141 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTSAPPAWPCLQTINYNH

SEQ ID NO: 761926 - protein, 199 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKSE

SEQ ID NO: 761927 - protein, 146 aa, Homo sapiens [sequence omitted]

SEQ ID NO: 761928 - protein, 132 aa, Homo sapiens
TDALSGGRAQHGELKDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761929 - protein, 230 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKGENGKLTKALFGGQPPPKGFLKGTSPRAGGLPE

SEQ ID NO: 761930 - protein, 231 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKEGGDGRQEPAVPQCSLAVSVRVAPSTINWCGRGS

SEQ ID NO: 761931 - protein, 117 aa, Homo sapiens; identical to SEQ ID NO: 761921

SEQ ID NO: 761932 - protein, 146 aa, Homo sapiens [sequence omitted]

SEQ ID NO: 761933 - protein, 146 aa, Homo sapiens [sequence omitted]

SEQ ID NO: 761934 - protein, 127 aa, Homo sapiens
MRQGLGPPCRAPLPPRLPSLASYHTTPGHPSCKCLPWSREAASSSCPLSSQPPSFICSGQNCVAPACASHGLGMDSLGPTHCQARKAAFACSCLGTAPGFPSILMCPLSPLQRPPTQHHRPGLACRL

SEQ ID NO: 761935 - protein, 127 aa, Homo sapiens; identical to SEQ ID NO: 761934

SEQ ID NO: 761936 - protein, 127 aa, Homo sapiens; identical to SEQ ID NO: 761934

SEQ ID NO: 761937 - protein, 714 aa, Homo sapiens; identical to SEQ ID NO: 761905

SEQ ID NO: 761938 - protein, 714 aa, Homo sapiens; identical to SEQ ID NO: 761905

SEQ ID NO: 761939 - protein, 714 aa, Homo sapiens; identical to SEQ ID NO: 761905

SEQ ID NO: 761940 - protein, 714 aa, Homo sapiens; identical to SEQ ID NO: 761905

SEQ ID NO: 761941 - protein, 714 aa, Homo sapiens; identical to SEQ ID NO: 761905

SEQ ID NO: 761942 - protein, 714 aa, Homo sapiens; identical to SEQ ID NO: 761905

SEQ ID NO: 761943 - protein, 455 aa, Homo sapiens [sequence omitted]

SEQ ID NO: 761944 - protein, 421 aa, Homo sapiens [sequence omitted]

SEQ ID NO: 761945 - protein, 581 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKGTAPGFPSILMCPLSPLQRPPTQHHRPGLACRL

SEQ ID NO: 761946 - protein, 146 aa, Homo sapiens [sequence omitted]

SEQ ID NO: 761947 - protein, 581 aa, Homo sapiens; identical to SEQ ID NO: 761945

SEQ ID NO: 761948 - protein, 562 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPEAWWASRPYTLKRDFFPLGQIAVLRGRASRAKFHSTLATKAQNPISACKPGARLSCGARTLTSFQAPTQEEGASTSGTIDALLSSSSKDDARGTCETLEMTQHHRAKLPPMY

SEQ ID NO: 761949 - protein, 305 aa, Homo sapiens [sequence omitted]

SEQ ID NO: 761950 - protein, 146 aa, Homo sapiens [sequence omitted]

SEQ ID NO: 761951 - protein, 162 aa, Homo sapiens
MASGVLTLPAHRRGATILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761952 - protein, 165 aa, Homo sapiens
MAGPIVREDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 761953 - protein, 146 aa, Homo sapiens [sequence omitted]

SEQ ID NO: 761954 - protein, 146 aa, Homo sapiens [sequence omitted]

SEQ ID NO: 761955 - protein, 177 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQVRAPLGRRGSRHWGRCGRMTHNTCS

SEQ ID NO: 761956 - protein, 83 aa, Homo sapiens; identical to SEQ ID NO: 761922

SEQ ID NO: 761957 - protein, 127 aa, Homo sapiens; identical to SEQ ID NO: 761934

SEQ ID NO: 761958 - protein, 99 aa, Homo sapiens
PCLAPAPSWGPNPSPILLGRGCASLTFTHSPGPGFKLNKKLYELIITRYSEPDLAVDFDNFVCCLVRLETMFRECPQLPPTLQLRPKRVPQELGGMTDG

SEQ ID NO: 761959 - protein, 152 aa, Homo sapiens
MHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 761960 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 761961 - protein, 152 aa, Homo sapiens; identical to SEQ ID NO: 761959

SEQ ID NO: 761962 - protein, 475 aa, Homo sapiens [sequence omitted]

SEQ ID NO: 761963 - protein, 426 aa, Homo sapiens
MNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 761964 - protein, 29 aa, Homo sapiens
MGRQVMKGINQGYVLGVTPLLSLDVCEKA

SEQ ID NO: 761965 - protein, 390 aa, Homo sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTGEKPYICKECGKTFRASSHLQKHVRIHTGEKPYICNECGKAYNRFYLLTKHLKTH

SEQ ID NO: 761966 - protein, 499 aa, Homo sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTGEKPYICKECGKTFRASSHLQKHVRIHTGEKPCPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 761967 - protein, 194 aa, Homo sapiens
MASVQASRRQWCYLCDLPKMPWAMVWDFSEAVCRGCVNFEGADRIELLIDAARQLKRSTCSPRAARPGPRPLTTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 761968 - protein, 169 aa, Homo sapiens
MASVQASRRQWCYLCDLPKMPWAMVWDFSEAVCRGCVNFEGADRIELLIDAARQLKRSHVLPEGRSPGPPALKHPATKDLAAAAAQGPQLPPPQAQPQPSGTGGGVSGQDRYDRATSSGRLPLPSPALEYTLGSRLANGLGREEAVAVGLVGAVGYSDCRLVGEILKHQ

SEQ ID NO: 761969 - protein, 584 aa, Homo sapiens
MASVQASRRQWCYLCDLPKMPWAMVWDFSEAVCRGCVNFEGADRIELLIDAARQLKRSHVLPEGRSPGPPALKHPATKDLAAAAAQGPQLPPPQAQPQPSGTGGGVSGQDRYDRATSSGRLPLPSPALEYTLGSRLANGLGREEAVAEGARRALLGSMPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 761970 - protein, 498 aa, Homo sapiens
MASVQASAASGATCATGGGVSGQDRYDRATSSGRLPLPSPALEYTLGSRLANGLGREEAVAEGARRALLGSMPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 761971 - protein, 130 aa, Homo sapiens
PTVPREGYMAAPGCGAGGQGTNEGPRVPGQGLRLPPGDNGKENLMARFVPLVRSPRGNLEGPLSSYSPSDPPRGSASPHPGLPPQALGGQASPPLLCCSFSQRTASALSTSRPCMCPHLSTPLAQLGPLF

SEQ ID NO: 761972 - protein, 61 aa, Homo sapiens
GLVVVEPSPGLPKPCLLSLLSTPRDLRASVSAFPKAVLAPSAILQPRQHPSKMLLLLPEAG

SEQ ID NO: 761973 - protein, 104 aa, Homo sapiens [sequence omitted]

SEQ ID NO: 761974 - protein, 250 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYLLGAWNLVEGRFILMGSGRGGDFQKNALGFGHRVAIPSGNRGRPGS

SEQ ID NO: 761975 - protein, 367 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPAPGPVPVPGPKSHPSASSGKLLLPQFGMVIILISVSAINLFVAL

SEQ ID NO: 761976 - protein, 450 aa, Homo sapiens
FSEEVIPGGLDARSCCSCCRWVRLLPVLIQPEAKRSTLGAKESSDGMLTIVDGNCVGKLGDPIWLVKVCQKEKRKPIFEEKRKMKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPAPGPVPVPGPKSHPSASSGKLLLPQFGMVIILISVSAINLFVAL

SEQ ID NO: 761977 - protein, 261 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGD

SEQ ID NO: 761978 - protein, 367 aa, Homo sapiens; identical to SEQ ID NO: 761975

SEQ ID NO: 761979 - protein, 82 aa, Homo sapiens
WKLEDHGEKNQKLEDHGMKIPEPFPLPEDKSQGNINNPTPGPVPVPGPKSHPSASSGKLLLPQFGMVIILISVSAINLFVAL

SEQ ID NO: 761980 - protein, 261 aa, Homo sapiens; identical to SEQ ID NO: 761977

SEQ ID NO: 761981 - protein, 367 aa, Homo sapiens; identical to SEQ ID NO: 761975

SEQ ID NO: 761982 - protein, 367 aa, Homo sapiens; identical to SEQ ID NO: 761975

SEQ ID NO: 761983 - protein, 205 aa, Homo sapiens
MTCFISPSSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADP

SEQ ID NO: 761984 - protein, 288 aa, Homo sapiens
ASEAEFLFDVTSSPKNWAQRSGGPGKDMNMVKLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADP

SEQ ID NO: 761985 - protein, 540 aa, Homo sapiens
FLGRGPAAARAAGASGGADPQPEPAGPGGVPALAAAVLGACEPRCAAPCPLPALSRCRGAGSRGSRGGRGAAGSGDAAAAAEWIRKGSFIHKPAHGWLHPDARVLGPGVSYVVRYMGCIEVLRSMRSLDFNTRTQVTREAINRLHEAVPGVRGSWKKKAPNKALASVLGKSNLRFAGMSISIHISTDGLSLSVPATRQVIANHHMPSISFASGGDTDMTDYVAYVAKDPINQRACHILECCEGLAQSIISTVGQAFELRFKQYLHSPPKVALPPERLAGPEESAWGDEEDSLEHNYYNSIPGKEPPLGGLVDSRLALTQPCALTALDQGPSPSLRDACSLPWDVGSTGTAPPGDGYVQADARGPPDHEEHLYVNTQGLDAPEPEDSPKKDLFDMRPFEDALKLHECSVAAGVTAAPLPLEDQWPSPPTRRAPVAPTEEQLRQEPWYHGRMSRRAAERMLRADGDFLVRDSVTNPGQYVLTGMHAGQPKHLLLVDPEGVVRTKDVLFESISHLIDHHLQNGQPIVAAESELHLRGVVSREP

SEQ ID NO: 761986 - protein, 126 aa, Homo sapiens
GGFCEVCKKLVGYLDRNLDFNTRRRWEAINRLHEAVPGVRGSWKKKAPNKALASVLGKSNLRFAGMSISIHISTDGLSLSVPATRQVIANHHMPSISFASGGDTVRPGMGVDLQPCRPPPAARPSH

SEQ ID NO: 761987 - protein, 179 aa, Homo sapiens [sequence omitted]

SEQ ID NO: 761988 - protein, 100 aa, Homo sapiens
TLCPHPLPHLSALLGWAAGNPGGGPRQVQLAPPRPQDMTDYVAYVAKDPINQRACHILECCEGLAQSIISTVGQAFELRFKQYLHSPPKVALPPERIGED

SEQ ID NO: 761989 - protein, 626 aa, Homo sapiens
FLGRGPAAARAAGASGGADPQPEPAGPGGVPALAAAVLGACEPRCAAPCPLPALSRCRGAGSRGSRGGRGAAGSGDAAAAAEWIRKGSFIHKPAHGWLHPDARVLGPGVSYVVRYMGCIEVLRSMRSLDFNTRTQVTSSCHHSGCRQDLDTDPASGSGLLLAAPTPTSDAEPSLWAEARDTLVPGKEGGRGARAGGRASAGCKDARGVGWCPSCTCPVGHSSPREAINRLHEAVPGVRGSWKKKAPNKALASVLGKSNLRFAGMSISIHISTDGLSLSVPATRQVIANHHMPSISFASGGDTDMTDYVAYVAKDPINQRACHILECCEGLAQSIISTVGQAFELRFKQYLHSPPKVALPPERLAGPEESAWGDEEDSLEHNYYNSIPGKEPPLGGLVDSRLALTQPCALTALDQGPSPSLRDACSLPWDVGSTGTAPPGDGYVQADARGPPDHEEHLYVNTQGLDAPEPEDSPKKDLFDMRPFEDALKLHECSVAAGVTAAPLPLEDQWPSPPTRRAPVAPTEEQLRQEPWYHGRMSRRAAERMLRADGDFLVRDSVTNPGQYVLTGMHAGQPKHLLLVDPEGVVRTKDVLFESISHLIDHHLQNGQPIVAAESELHLRGVVSREP

SEQ ID NO: 761990 - protein, 540 aa, Homo sapiens; identical to SEQ ID NO: 761985

SEQ ID NO: 761991 - protein, 238 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 761992 - protein, 219 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVRGANRGLCQRRLKSRTNKASRL

SEQ ID NO: 761993 - protein, 238 aa, Homo sapiens; identical to SEQ ID NO: 761991

SEQ ID NO: 761994 - protein, 192 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRLKSRTNKASRL

SEQ ID NO: 761995 - protein, 284 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 761996 - protein, 283 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVKQMPIMVTHQVINKENFHSYHTTQETSKAPHNTKHHRHHATTRRRNSKSENNREREKKKRETRDARPTLARAQQLSNNREKQSAPNGGGKKTKPDRHP

SEQ ID NO: 761997 - protein, 284 aa, Homo sapiens; identical to SEQ ID NO: 761995

SEQ ID NO: 761998 - protein, 250 aa, Homo sapiens
MFLAYQEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 761999 - protein, 284 aa, Homo sapiens; identical to SEQ ID NO: 761995

SEQ ID NO: 762000 - protein, 228 aa, Homo sapiens
CRVRWRQPRRKASSIHPYSFPGKPGSKPISYISLCRCQCMLWLLAKSWFGLHRKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 762001 - protein, 284 aa, Homo sapiens; identical to SEQ ID NO: 761995

SEQ ID NO: 762002 - protein, 256 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGK

SEQ ID NO: 762003 - protein, 258 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSVRMCCQIGSALMFVSKFSENVVI

SEQ ID NO: 762004 - protein, 134 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRKSRVRKSRVRKSR

SEQ ID NO: 762005 - protein, 124 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKQEWKGTCRRGREFS

SEQ ID NO: 762006 - protein, 268 aa, Homo sapiens
CVCVCIGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 762007 - protein, 266 aa, Homo sapiens
MCNTPTYCDLGKAAKDVFNKGYGFGMVKIDLTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 762008 - protein, 256 aa, Homo sapiens; identical to SEQ ID NO: 762002

SEQ ID NO: 762009 - protein, 167 aa, Homo sapiens
KQQRRCESAEGNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 762010 - protein, 284 aa, Homo sapiens; identical to SEQ ID NO: 761995

SEQ ID NO: 762011 - protein, 185 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHV

SEQ ID NO: 762012 - protein, 1998 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGCQTLPSRPRGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 762013 - protein, 1076 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETGTSHGRCPQECVVFVWTLESHPLIFSLAYIWQSSVSGFCNAD

SEQ ID NO: 762014 - protein, 1094 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQVSRATTSSPSGRTEF

SEQ ID NO: 762015 - protein, 1008 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEVRSRQ

SEQ ID NO: 762016 - protein, 969 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVLAAQLCCFSSLFLYFRCILFLISSVTS

SEQ ID NO: 762017 - protein, 1492 aa, Homo sapiens
MSTNLMKRTRLCNLLKSLVVQNRIPQCFSGYKKKQVMLLGVLNPFGSISCCFGTIINICYKKYHLYTHSDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGCQTLPSRPRGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPAQEVVVCMRRDTALETANAKAYKRTPTSLARGPHHLRSWRSSRRSSRSAQAGKHQEYLNSILQHAKDFKEYHRSVTGKIQKLTKAVATYHANTERRK

SEQ ID NO: 762018 - protein, 1100 aa, Homo sapiens
MVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCPNTSVVVTLLKKRSQDRLSDVSRPRGPATWAMAPSKPDIMIILLSKLMKEGDMFYKKGKVKEAAQRYQYALKKFPREGFGEDLKPFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 762019 - protein, 106 aa, Homo sapiens
EIFFFNNKKNNKEQTDQQNKCRTNLALSHGSTTNKHSSLNLVESQDLVVIGLLEDQMRAFIKPFFIKVLPIAFKTAAIIMENNNYFQKGYSPFYPFLCLCKALYRI

SEQ ID NO: 762020 - protein, 438 aa, Homo sapiens
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 762021 - protein, 426 aa, Homo sapiens
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 762022 - protein, 466 aa, Homo sapiens
GARPPVCTGSTMSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 762023 - protein, 73 aa, Homo sapiens
VLCNSKLPCEVGALFSIIPIGNGGPGQFHNKAMWPGSLCGLHPDSILPAKSVGVSPLLLPALFTGGPHCPGVL

SEQ ID NO: 762024 - protein, 222 aa, Homo sapiens
PLHLPGLPGPSLAPSFLWRELWLGGEWGPLNIPARKGDRRCSDGLVREVVPQSPLSSLAPQIVYFTATFPYVVLVVLLVLGVLLPGALDSIIYYLKPDWSKLGSPQPLGSYNRFNNNCYNGTSFFAGFVVFSILGFMAAEQGMHISKVAESEEISVALCCALRFVIDLSMVTDGGMYVFQLFDYYSASGTTLLWQAFWECVVVAWVYGADRFTDDIACMIGY

SEQ ID NO: 762025 - protein, 97 aa, Homo sapiens
PLHLPGLPGPSLAPSFLWRELWLGGEWGPLNIPARKGDRRCSEWACEGGGAAVPAEQPGPPDRVLHCYIPLRGPGRAACAWSAAAWRPGQHHLLSQA

SEQ ID NO: 762026 - protein, 230 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 762027 - protein, 172 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLEH

SEQ ID NO: 762028 - protein, 186 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKYQKYRQEMEANGVEVVYLDGMKSREELFREVLEDIQNSLLNRSQESAPSPARPARTQGPGRGCGHRTARPAASQQDSM

SEQ ID NO: 762029 - protein, 532 aa, Homo sapiens
MPQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 762030 - protein, 255 aa, Homo sapiens
MITEPFKLINWTGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 762031 - protein, 532 aa, Homo sapiens; identical to SEQ ID NO: 762029

SEQ ID NO: 762032 - protein, 97 aa, Homo sapiens
TIFVPMFSHSLIGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 762033 - protein, 532 aa, Homo sapiens; identical to SEQ ID NO: 762029

SEQ ID NO: 762034 - protein, 532 aa, Homo sapiens; identical to SEQ ID NO: 762029

SEQ ID NO: 762035 - protein, 532 aa, Homo sapiens; identical to SEQ ID NO: 762029

SEQ ID NO: 762036 - protein, 82 aa, Homo sapiens
MEPPSPSPTHLSCIFFLLITVSPLEASSTRARVFPCLPLYAECPEQSLAQGKEKSHPGGGGERPGLAGQGEPDHPAGARDGR

SEQ ID NO: 762037 - protein, 396 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762038 - protein, 426 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTGERHPLTCLGALALSLRWGPQSPAELLIVAEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762039 - protein, 396 aa, Homo sapiens; identical to SEQ ID NO: 762037

SEQ ID NO: 762040 - protein, 396 aa, Homo sapiens; identical to SEQ ID NO: 762037

SEQ ID NO: 762041 - protein, 396 aa, Homo sapiens; identical to SEQ ID NO: 762037

SEQ ID NO: 762042 - protein, 396 aa, Homo sapiens; identical to SEQ ID NO: 762037

SEQ ID NO: 762043 - protein, 159 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTGERHPLTCLGALALSLRWGPQSPAEL

SEQ ID NO: 762044 - protein, 479 aa, Homo sapiens
TPASQNAWRIVLQPISVELLPRPASRRRPGGAERAPRFTALSARTSGHGQGVTSGGGQGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFRRPAPPGQGFFPACHCMPSVQNKAKHKEKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762045 - protein, 66 aa, Homo sapiens
RLGAGFNQRRLNPLPGSSPSWELGSEGAKRDKKTSLGAHVVLSALGRALEKTIAFQGSSLPQREGN

SEQ ID NO: 762046 - protein, 447 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDCAEEARGKRGQGGSELPGDGGSSAMSGLWSTRGQFWTPSPAAPEMSSPLLYAYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762047 - protein, 396 aa, Homo sapiens; identical to SEQ ID NO: 762037

SEQ ID NO: 762048 - protein, 396 aa, Homo sapiens; identical to SEQ ID NO: 762037

SEQ ID NO: 762049 - protein, 453 aa, Homo sapiens
TPASQNAWRIVLQPISVELLPRPASRRRPGGAERAPRFTALSARTSGHGQGVTSGGGQGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762050 - protein, 186 aa, Homo sapiens
MSGLWSTRGQFWTPSPAAPEMSSPLLYAYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 762051 - protein, 537 aa, Homo sapiens
FALGARVAGAPESGAMSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTVATATATTTSSSSTTGFALNLKPLAPAGIPSNTAAAVTAPPGPGTTAGAAASSAMTYAHVESLINKWSLELEDQERHFLQQATQVNAWDRTLIENGEKITSLHREVKKVKLDQKRLDQELDFILSQQKELEDLLSPLEELVKEQSVTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 762052 - protein, 330 aa, Homo sapiens
FALGARVAGAPESGAMSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 762053 - protein, 186 aa, Homo sapiens
AIFSFIIIFLRSMKVHIARSPQGIEQCGSLFLFPRGSCCMVSVCCLPLCCIFTSGRPAVCSPLGTRGHHSLLEQKSQFWHQQYHSVAGSRQRGHGPGGFIPGCKMPKCRAAGEAHAERAGSAHSPPLQGVYWISCQSTKMPGGLMMPGEPPWHSRGKGLTPRGDLERDIPYPTPSARSSPSLPQEG

SEQ ID NO: 762054 - protein, 128 aa, Homo sapiens
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 762055 - protein, 128 aa, Homo sapiens; identical to SEQ ID NO: 762054

SEQ ID NO: 762056 - protein, 128 aa, Homo sapiens; identical to SEQ ID NO: 762054

SEQ ID NO: 762057 - protein, 177 aa, Homo sapiens
MKTVTMMMVVEMQALTQVLRAVLSACTWVSRKGDLQRMKQTHKGKPPSSMAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 762058 - protein, 128 aa, Homo sapiens; identical to SEQ ID NO: 762054

SEQ ID NO: 762059 - protein, 128 aa, Homo sapiens; identical to SEQ ID NO: 762054

SEQ ID NO: 762060 - protein, 128 aa, Homo sapiens; identical to SEQ ID NO: 762054

SEQ ID NO: 762061 - protein, 126 aa, Homo sapiens
SQTTGLKAALIWLLCLSPGPGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 762062 - protein, 384 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNITLTWRQDGVSLSHDTQQWGDVLPDGNGTYQTWVATRICRGEEQRFTCYMEHSGNHSTHPVPSGKVLVLQSHWQTFHVSAVAAAAAIFVIIIFYVRCCKKKTSAAEGPELVSLQVLDQHPVGTSDHRDATQLGFQPLMSALGSTGSTEGT

SEQ ID NO: 762063 - protein, 476 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGESRQGQELTGEAFSRKVRGREQGPVSSHWIWLRLGVRNGGQWNSAGRRAGTQPTQGGMEEGQGGIPPGLSSSLGWKGDGFGNGEVTAVVGAGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNITLTWRQDGVSLSHDTQQWGDVLPDGNGTYQTWVATRICRGEEQRFTCYMEHSGNHSTHPVPSGKVLVLQSHWQTFHVSAVAAAAAIFVIIIFYVRCCKKKTSAAEGPELVSLQVLDQHPVGTSDHRDATQLGFQPLMSALGSTGSTEGT

SEQ ID NO: 762064 - protein, 222 aa, Homo sapiens
MNVRNFLKEDAMKTKTHYHAMHADCLQELRRYLESGVVLRRTVPPMVNVTRSEASEGNITVTCRASSFYPRNITLTWRQDGVSLSHDTQQWGDVLPDGNGTYQTWVATRICRGEEQRFTCYMEHSGNHSTHPVPSGKVLVLQSHWQTFHVSAVAAAAAIFVIIIFYVRCCKKKTSAAEGPELVSLQVLDQHPVGTSDHRDATQLGFQPLMSALGSTGSTEGT

SEQ ID NO: 762065 - protein, 288 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNITLTWRQDGVSLSHDTQQWGDVLPDGNGTYQTWVATRICRGEEQRFTCYMEHSGNHSTHPVPSGKVLVLQSHWQTFHVSAVAAAAAIFVIIIFYVRCCKKKTSAAEGPELVSLQVLDQHPVGTSDHRDATQLGFQPLMSALGSTGSTEGT

SEQ ID NO: 762066 - protein, 287 aa, Homo sapiens
MTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNITLTWRQDGVSLSHDTQQWGDVLPDGNGTYQTWVATRICRGEEQRFTCYMEHSGNHSTHPVPSGKVLVLQSHWQTFHVSAVAAAAAIFVIIIFYVRCCKKKTSAAEGPELVSLQVLDQHPVGTSDHRDATQLGFQPLMSALGSTGSTEGT

SEQ ID NO: 762067 - protein, 287 aa, Homo sapiens; identical to SEQ ID NO: 762066

SEQ ID NO: 762068 - protein, 240 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYPQRGLRGQHHRDMQGFQLLSPEYHTDLASGWGIFEPRHPAVGGCPA

SEQ ID NO: 762069 - protein, 86 aa, Homo sapiens
EDPPRIEVSEEITREAKKARKVGGLTGSSSDDSGSESDASDNEESDYESSKNMSSGDDDDFNPFLDESNEDDENGKFSILNIHESI

SEQ ID NO: 762070 - protein, 1392 aa, Homo sapiens
MVEPGQDLLLAALRESGISPNDLFDIDGGDAGLATPMPTPSVQQSVPLSALELGLETEAAVPVKQEPETVPTPALLNVRQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 762071 - protein, 1392 aa, Homo sapiens; identical to SEQ ID NO: 762070

SEQ ID NO: 762072 - protein, 717 aa, Homo sapiens
SIQSALLASGLGSKRPEFFIYTSYLTCSYQYGGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 762073 - protein, 1392 aa, Homo sapiens; identical to SEQ ID NO: 762070

SEQ ID NO: 762074 - protein, 641 aa, Homo sapiens [sequence omitted]

SEQ ID NO: 762075 - protein, 398 aa, Homo sapiens [sequence omitted]

SEQ ID NO: 762076 - protein, 631 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSVSSSQSLCLMLWFCLFVCLFVF

SEQ ID NO: 762077 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 762078 - protein, 178 aa, Homo sapiens [sequence omitted]

SEQ ID NO: 762079 - protein, 178 aa, Homo sapiens [sequence omitted]

SEQ ID NO: 762080 - protein, 178 aa, Homo sapiens [sequence omitted]

SEQ ID NO: 762081 - protein, 139 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEPSAATMNPASRHSSPHLGS

SEQ ID NO: 762082 - protein, 124 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFESPGQ

SEQ ID NO: 762083 - protein, 71 aa, Homo sapiens
FDLWSSSAPRELSSPPEYDVTGNTLSLHPMRLPSPPRCPEHQWAPVARPGRLRPLPHRWPVCLAFIHDMQA

SEQ ID NO: 762084 - protein, 1504 aa, Homo sapiens
FRGSDVQGTAGRLLKQNETWSKALSLTHALKRCHESSFPQGIVSVGVPGPGWGSCRAHGQGRSWQENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSPEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQASGLRAPLCPVRQQLQTGLPLLDAVNLSVCSYKRGPDLRVQCQEALGRGAERPSARVPLRQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRK

SEQ ID NO: 762085 - protein, 128 aa, Homo sapiens
TGLRWSLLSDLPHGSPRHALLGMENVSLADILSLRDRGLSEQEAWAVCLECSLSMRSVAHAAIFQSLCITPDTLAFNTSGNVCFMEQLSDDPEGAFVPPEFDVTGNTFEPSAATMNPASRHSSPHLGS

SEQ ID NO: 762086 - protein, 119 aa, Homo sapiens
MEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 762087 - protein, 133 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEPPPHEAPLSTPLP

SEQ ID NO: 762088 - protein, 1468 aa, Homo sapiens
FRGSDVQGTAGRLLKQNETWSKALSLTHALKRCHESSFPQGIVSVGVPGPGWGSCRAHGQGRSWQENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSPEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQASGLRAPLCPVRQQLQTGLPLLDAVNLSVCSYKRGPDLRVQCQEALGRGAERPSARVPLRQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKNPYTFSPDPKLQSYLKQRIARFSGADISTLAADSRANFHQVSSEKHSRKIQDKLRRMKATFQ

SEQ ID NO: 762089 - protein, 1376 aa, Homo sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSPEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKNPYTFSPDPKLQSYLKQRIARFSGADISTLAADSRANFHQVSSEKHSRKIQDKLRRMKATFQ

SEQ ID NO: 762090 - protein, 831 aa, Homo sapiens
CVWWGWREAQRGEGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPRGAPGTTPPPPPATLPPEPEPEPPPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYHPGPAPGTGRCASSLPRGPGPCCPSGLGPPPPPPPPSPSIFGPFPPPPPTATSHNNTLPHPHSTTRV

SEQ ID NO: 762091 - protein, 814 aa, Homo sapiens
MCLVGLAEAQRGEGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPRGAPGTTPPPPPATLPPEPEPEPPPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYHPGPAPGTGRCASSLPRGPGPCCPSGLGPPPPPPPPSPSIFGPFPPPPPTATSHNNTLPHPHSTTRV

SEQ ID NO: 762092 - protein, 834 aa, Homo sapiens
VSGGAGGKLNAGKGSRRRPPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAESCWMAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPRGAPGTTPPPPPATLPPEPEPEPPPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYHPGPAPGTGRCASSLPRGPGPCCPSGLGPPPPPPPPSPSIFGPFPPPPPTATSHNNTLPHPHSTTRV

SEQ ID NO: 762093 - protein, 1110 aa, Homo sapiens
MCLVGLAEAQRGEGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAESCWMAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGLRARGAGRGGGALPPSHGRRSSVKALTLACPLARVKPTQTPSVPGTELSVGDSAVSDREAAVLSGELGAHSVALAWRLSLPPPCLIPPARPPRALHLWLTAQVCVSECVEEFVCLYFCLCLSENPLTALHLPLLLSFVCLLFAFSGCRLISAWLVVSVSGCPSRVFEPCLCFIQAQLLLLPGYLCVCPCPSARISGCLCQSVFHPYLPICLKRQAVSLSLHIHLCLSASVTFSLAFLAVPLSLCISVCLPAHCHPPSFRALPSLLLSLPSCAHRDPNQPVPQDTKFIHTKPNRFEEVVWSKFNSKEKQYLHIGLKPRVRDNYRANKVAFWLELVPHLHNLHTELFTTTTRLPPYATRWPPRPPRGAPGTTPPPPPATLPPEPEPEPPPRAYDRFPGDSRDYSTELSVTVAVGASLLFLNILAFAALYYKRDRRQELRCRRLSPPGGSGSGVPGGGPPAAPPRAVELPPEEELVSLQLKRGGGVGADPAEALRPACPPDYHPGPAPGTGRCASSLPRGPGPCCPSGLGPPPPPPPPSPSIFGPFPPPPPTATSHNNTLPHPHSTTRV

SEQ ID NO: 762094 - protein, 834 aa, Homo sapiens; identical to SEQ ID NO: 762092

SEQ ID NO: 762095 - protein, 834 aa, Homo sapiens; identical to SEQ ID NO: 762092

SEQ ID NO: 762096 - protein, 834 aa, Homo sapiens; identical to SEQ ID NO: 762092

SEQ ID NO: 762097 - protein, 834 aa, Homo sapiens; identical to SEQ ID NO: 762092

SEQ ID NO: 762098 - protein, 834 aa, Homo sapiens; identical to SEQ ID NO: 762092

SEQ ID NO: 762099 - protein, 449 aa, Homo sapiens
MYSFNTLRLYLSGAIVFFSLAASKEAEAARSATKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 762100 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762101 - protein, 484 aa, Homo sapiens; identical to SEQ ID NO: 762100

SEQ ID NO: 762102 - protein, 484 aa, Homo sapiens; identical to SEQ ID NO: 762100

SEQ ID NO: 762103 - protein, 621 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLGSLPPTHPFWVGVVAKTQGKRGSCPSELCGKGLWRDWKGWGEASISPGDGDTMPPGTFPPSPTLILYFLFQKAKQKQKQVSQGRDLGWGDHGLWLWGQCSQAVIVGGQNREGREPRTSGSALTPTRHETGTRAMVSTDLMSILQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762104 - protein, 650 aa, Homo sapiens
AGAACRAAAGFCSRLGAPGPGEGERPLAWSMSFSDSSATFLLNEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLGSLPPTHPFWVGGVAKTQGKRGSCPSELCGKGLWRDWKGWGEASISPGDGDTMPPGTFPPSPTLILYFLFQKAKQKQKQVSQGRDLGWGDHGLWLWGQCSRQSLLEEQNREGREPRTSGSALTPTRHETGTRAMVSTDLMSILQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762105 - protein, 447 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQLLSLL

SEQ ID NO: 762106 - protein, 162 aa, Homo sapiens
AGAACRAAAGFCSRLGAPGPGEGERPLAWSMSFSDSSATFLLNEGSADSYTSRPSLDSDVSLEEDRESARREVESQAQQQLERAKHKPVAFAVRTNVSYCGVLDEECPVQGSGVNFEAKDFLHIKENLGGPPCLSHSFALHPVISVLVPHTSLENRAPDFVP

SEQ ID NO: 762107 - protein, 145 aa, Homo sapiens
TSHRRFKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIGKCRVRSSAYLNLRCGVGDPL

SEQ ID NO: 762108 - protein, 484 aa, Homo sapiens; identical to SEQ ID NO: 762100

SEQ ID NO: 762109 - protein, 308 aa, Homo sapiens
MRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762110 - protein, 473 aa, Homo sapiens
MRNWGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762111 - protein, 348 aa, Homo sapiens
MRPVVLVGPSLKGYEVTDMMQKALFDFLKHRFDGRISITRVTADLSLAKRSVLNNPGKRTIIERSSARSSIGFDECPFPPIPSCPPFGSPQSCWSEQWAELLVSTAAASLIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 762112 - protein, 327 aa, Homo sapiens
GAPRRPAPCPVRPPSTRRCLARAVRPSCPAGWSPRPSRPAGTPNKAEMTSKEDGKAAPGEERRRSPLDHLPPPANSNKPDAVQHRGHPQQAVCAEKLLAAWGGAPAGRRGQARAGRLALAGRALLSKTSPLCALEELASKTFKGLEVSVLQAAEGRDGMTIFGQRQTPKKRRKSRTAFTNHQIYELEKRFLYQKYLSPADRDQIAQQLGLTNAQVITWFQNRRAKLKRELEEMKADVESPKKLGPSGQMDIVALAELEQNSEATAGGGGGCGRAKSRPGSPVLPPGAPKAPGRCALQLSPASPLTDQPASSQDCSEDEEDEEIDVDD

SEQ ID NO: 762113 - protein, 124 aa, Homo sapiens
MLQQNLTCTINLFCQILDRYVYVDLFPFEERGKKLVLIKGYSRIKNILGHEIVTCISPTSQDSMFNIFISLCLQKQMNVPLYFLKNEKMNVSFFASSMEAKNLNTINILMLDNGSVFKMQNVLF

SEQ ID NO: 762114 - protein, 46 aa, Homo sapiens
EGGLHVTDEGATLDGLLVPRHQPARPRNCRGGRARNCGEAEESNLL

SEQ ID NO: 762115 - protein, 610 aa, Homo sapiens
MDSVAFEDVAVNFTQEEWALLGPSQKSLYRNVMQETIRNLDCIEMKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSNLKVHERIHSGEKPYECKECGKAFSWLTCLLRHERIHTGEKPYECLQCGKAFTRSRFLRGHEKTHTGEKLYECKECGKALSSLRSLHRHKRTHWKDTL

SEQ ID NO: 762116 - protein, 105 aa, Homo sapiens
MERSHIHINNVGKPSVISTPSRHMKGPPPERNPSIVKNVQKPLVLLETSEDTWRHTMEMDLINVSCVGKPLFGPVYFICTKEHTLERNRMNVSSVLKPFLFTVPI

SEQ ID NO: 762117 - protein, 257 aa, Homo sapiens
MDSVAFEDVAVNFTQEEWALLGPSQKSLYRNVMQETIRNLDCIEMKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKACMNVRNVGKH

SEQ ID NO: 762118 - protein, 386 aa, Homo sapiens
EFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVCQGTLLPSNPGDLPTFRLPFWPFGWGLGFC

SEQ ID NO: 762119 - protein, 211 aa, Homo sapiens
RPDTQGPSLPHVSGFSQTCFLWPQMTPPGRLRQTSPNQWPSSRPHPAHIHSVTRSLFAAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYPAPAPAPTTALP

SEQ ID NO: 762120 - protein, 392 aa, Homo sapiens
SGDDEETHLPPPIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYCPLRACSALANTSLLSSVLTAAGQLQAWPCAMRVSLLGPHWGWRVHGDGLGPRVFLPHPTPLCLHAVTPSKSAPAHSVLRPPFPAPLFGSGIPTTALQETSAWTQALWSKGINSPDF

SEQ ID NO: 762121 - protein, 438 aa, Homo sapiens
EFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGETREYEVSI

SEQ ID NO: 762122 - protein, 291 aa, Homo sapiens
SGDDEETHLPPPIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYPPPPPPLQPHYHRVSV

SEQ ID NO: 762123 - protein, 160 aa, Homo sapiens
PGSHGSQVMGFPRREGRERERFGPSRLKSSFPTPSQLEGAGSQMPLGRGERIWAPGDRDLCSSHTLCVFSCQGTCCLQHPGCCPHCSCHLLATGGDGVVGRRCILLLLQVSLASLSALHTCIPHSYPVLLTCRLLCPTGSREKAPCSCPAPAPAPTTALP

SEQ ID NO: 762124 - protein, 451 aa, Homo sapiens
GTRPGASLGASQGPPTPGMTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 762125 - protein, 179 aa, Homo sapiens
MIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFHHPRPAFSWCFQTPRALVNPILEGKVHRHLQEQKSGLAT

SEQ ID NO: 762126 - protein, 148 aa, Homo sapiens
MIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWGKDEFHHFLMLSCLSSSELPAFYSYIPKLVFHTSWVSFFLLK

SEQ ID NO: 762127 - protein, 166 aa, Homo sapiens
MIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFHHPRPAFSWCFQTPRALVNPILEGKG

SEQ ID NO: 762128 - protein, 179 aa, Homo sapiens
MIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFHHPRPAFSWCFQTPRALVNPILEGKVHHHLQEKKNGLAK

SEQ ID NO: 762129 - protein, 210 aa, Homo sapiens
RLWAVAPVLVLRTMLCSPRKLYQASLLRSMEEDAHSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFHHPRPAFSWCFQTPRALVNPILEGKVHRHLQEQKSGLAT

SEQ ID NO: 762130 - protein, 130 aa, Homo sapiens [sequence omitted]

SEQ ID NO: 762131 - protein, 194 aa, Homo sapiens
MILNKALMLGALALTTVMSPCGGEDIVEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFHHPRPAFSWCFQTPRALVNPILEGKVHRHLQEQKSGLAT

SEQ ID NO: 762132 - protein, 172 aa, Homo sapiens
MIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETLVCALGLSVGLMGIVVGTVFIIQGLRSVGASRHRHVYHLKEGACMIRAEMTA

SEQ ID NO: 762133 - protein, 75 aa, Homo sapiens
SLCRVEFRLLQRPGSRDTPWDMSASASLASLVCNVQSLHGFCKTHWHAYAKFINSQKPGGEPLRTPRSRGHLIAT

SEQ ID NO: 762134 - protein, 488 aa, Homo sapiens
LTPAQWKLASLPLWVQSCKKHQARPLQKPQPRPSPPSQGHSAEACTPAKSLRLLAAAVSMAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMERSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 762135 - protein, 503 aa, Homo sapiens
LTPAQWKLASLPLWVQSCKKHQARPLQKPQPRPSPPSQGHSAEACTPAKSLRLLAAAVSMAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMERSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAVAAFTEVLNPSKSFMKFGINFFQTPVNVDSLTSSHESQMFLTACRLVIFSRRFSTYFAQIHLRNHSVLHLCPHKIYLLKN

SEQ ID NO: 762136 - protein, 208 aa, Homo sapiens
LTPAQWKLASLPLWVQSCKKHQARPLQKPQPRPSPPSQGHSAEACTPAKSLRLLAAAVSMAQAPADPGREGHLEQRILQVLTEAGSPVKLAQLVKECQAPKRELNQVLYRMKKELKVSLTSPATWCLGGTDPEGEGPAELALSSPGNCHPGEAGLTLQGASWQWTSTDLSLGSNLNSATWELTGFLSLCLGFFFWLMELTAGLLGRGC

SEQ ID NO: 762137 - protein, 307 aa, Homo sapiens
LTPAQWKLASLPLWVQSCKKHQARPLQKPQPRPSPPSQGHSAEACTPAKSLRLLAAAVSMAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGKSPKRAQGGDLGGEPPDPLGGGKG

SEQ ID NO: 762138 - protein, 142 aa, Homo sapiens
MSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATVK

SEQ ID NO: 762139 - protein, 208 aa, Homo sapiens
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 762140 - protein, 153 aa, Homo sapiens
MSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATAAEGFTSMISQHP

SEQ ID NO: 762141 - protein, 178 aa, Homo sapiens
GRVGRPTRRYSQLWSRSHPFCCSRGPLAMAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 762142 - protein, 150 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 762143 - protein, 150 aa, Homo sapiens; identical to SEQ ID NO: 762142

SEQ ID NO: 762144 - protein, 150 aa, Homo sapiens; identical to SEQ ID NO: 762142

SEQ ID NO: 762145 - protein, 145 aa, Homo sapiens
RVRPRVRKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 762146 - protein, 150 aa, Homo sapiens; identical to SEQ ID NO: 762142

SEQ ID NO: 762147 - protein, 150 aa, Homo sapiens; identical to SEQ ID NO: 762142

SEQ ID NO: 762148 - protein, 122 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSSSAYVSYGGLLMRLQGDANNLHGFEVDSRVYLLMKKLAF

SEQ ID NO: 762149 - protein, 132 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGSAYVSYGGLLMRLQGDANNLHGFEVDSRVYLLMKKLAF

SEQ ID NO: 762150 - protein, 150 aa, Homo sapiens; identical to SEQ ID NO: 762142

SEQ ID NO: 762151 - protein, 150 aa, Homo sapiens; identical to SEQ ID NO: 762142

SEQ ID NO: 762152 - protein, 150 aa, Homo sapiens; identical to SEQ ID NO: 762142

SEQ ID NO: 762153 - protein, 185 aa, Homo sapiens
YSPRALLASEAPTRRTYSQLWSRSHPFCCSRGPLAMAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 762154 - protein, 147 aa, Homo sapiens
MQSHTVVSPLIPLSLFSCFSPVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 762155 - protein, 175 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLLRLRAAEWQCSRITGWGLLFQLCVRVLWGPAHEAAGGCQQPAWIRGGLQSLSPDEEASLLNLA

SEQ ID NO: 762156 - protein, 175 aa, Homo sapiens; identical to SEQ ID NO: 762155

SEQ ID NO: 762157 - protein, 136 aa, Homo sapiens
EHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 762158 - protein, 136 aa, Homo sapiens; identical to SEQ ID NO: 762157

SEQ ID NO: 762159 - protein, 113 aa, Homo sapiens
GSLTERLKPNQRSIKCFPCHVIIKGLFIKLFFPSTSCPSIKTKLTVHTKKQKTQLKEKEQALEPDPDMAVRFELLDRKFKTTIIKMLRALIDRVESMQEKMDKKKKRNNRWTV

SEQ ID NO: 762160 - protein, 833 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 762161 - protein, 881 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLELANRKDSISICELSELMDKYKEKGVNRSVGFLGIGINQDMMIAWKQLLVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 762162 - protein, 821 aa, Homo sapiens
MQLLRRRVKEKRREPETKQGGIHHLEVLAGKEDKDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 762163 - protein, 807 aa, Homo sapiens
TSIFHRPSTPSQPKMGFGYKDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 762164 - protein, 177 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQV

SEQ ID NO: 762165 - protein, 177 aa, Homo sapiens; identical to SEQ ID NO: 762164

SEQ ID NO: 762166 - protein, 833 aa, Homo sapiens; identical to SEQ ID NO: 762160

SEQ ID NO: 762167 - protein, 833 aa, Homo sapiens; identical to SEQ ID NO: 762160

SEQ ID NO: 762168 - protein, 793 aa, Homo sapiens
MEQLVVDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 762169 - protein, 206 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQDGAKVELGDMFWEIFKSIFIKHLWFVGSKT

SEQ ID NO: 762170 - protein, 809 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTEGKTRFARAPPLALVTR

SEQ ID NO: 762171 - protein, 580 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRYRPRQAGDWRWTRWSRTCKQAFLVRSVTPDLRPPPVRTYGFATSCTSPLGLAAAPYTL

SEQ ID NO: 762172 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 762173 - protein, 934 aa, Homo sapiens
RPPAGSCVRPSAGQSVHARKARRGGRGAWEGTGAEAGPRLPPTPGGAQEAAVLEREPEPEPETKRGGREHEWGGACHGPPPPSSPSSPSPAPEPQSRRAARGSTPHPSPVRSAATQAFQDTVEREQGGRDAPFGRSVGEGGPDRREARSPTEAGRRVWDAVGSAKGWLRAAGAAGCGPGLLGDRPCLAGNRDQETTQKRLDLEQGRLPHSLPEPAEGAKDFRAVSSGIRETLAFQGSTLYRRRLYREGVFAAWMAIPHSFNGGLYGLRENPELERRPDGPCCPPGERGSCRLLPGPGGAGPAIVGDLAPEAVAAMSRPGHGGLMPVNGLGFPPQNVARVVVWEWLNEHSRWRPYTATVCHHIENVLKEDARGSVVLGQVDAQLVPYIIDLQSMHQFRQDTGTMRPVRRNFYDPSSAPGKGIVWEWENDGGAWTAYDMDICITIQNAYEKQHPWLDLSSLGFCYLIYFNSMSQMNRQTRRRRRLRRRLDLAYPLTVGSIPKSQSWPVGASSGQPCSCQQCLLVNSTRAASNAILASQRRKAPPAPPLPPPPPPGGPPGALAVRPSATFTGAALWAAPAAGPAEPAPPPGAPPRSPGAPGGARTPGQNNLNRPGPQRTTSVSARASIPPGVPALPVKNLNGTGPVHPALAGMTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAAKA

SEQ ID NO: 762174 - protein, 241 aa, Homo sapiens
HGPSAGSSPALNLGYQVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAAKA

SEQ ID NO: 762175 - protein, 865 aa, Homo sapiens
RPPAGSCVRPSAGQSVHARKARRGGRGAWEGTGAEAGPRLPPTPGGAQEAAVLEREPEPEPETKRGGREHEWGGACHGPPPPSSPSSPSPAPEPQSRRAARGSTPHPSPVRSAATQAFQDTVEREQGGRDAPFGRSVGEGGPDRREARSPTEAGRRVWDAVGSAKGWLRAAGAAGCGPGLLGDRPCLAGNRDQETTQKRLDLEQGRLPHSLPEPAEGAKDFRAVSSGIRETLAFQGSTLYRRRLYREGVFAAWMAIPHSFNGGLYGLRENPELERRPDGPCCPPGERGSCRLLPGPGGAGPAIVGDLAPEAVAAMSRPGHGGLMPVNGLGFPPQNVARVVVWEWLNEHSRWRPYTATVCHHIENVLKEDARGSVVLGQVDAQLVPYIIDLQSMHQFRQDTGTMRPVRRNFYDPSSAPGKGIVWEWENDGGAWTAYDMDICITIQNAYEKQHPWLDLSSLGFCYLIYFNSMSQMNRQTRRRRRLRRRLDLAYPLTVGSIPKSQSWPVGASSGQPCSCQQCLLVNSTRAASNAILASQRRKAPPAPPLPPPPPPGGPPGALAVRPSATFTGAALWAAPAAGPAEPAPPPGAPPRSPGAPGGARTPGQNNLNRPGPQRTTSVSARASIPPGVPALPVKNLNGTGPVHPALAGMTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVGAQP

SEQ ID NO: 762176 - protein, 934 aa, Homo sapiens; identical to SEQ ID NO: 762173

SEQ ID NO: 762177 - protein, 285 aa, Homo sapiens
MTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAAKA

SEQ ID NO: 762178 - protein, 82 aa, Homo sapiens
DLRTPQARAITPLGVLQLLASPSFGALLHPPHPDASIQGERWSQHAQASRRLSTEPWQVQNPSQWHKLSAASQAEWVEQAQQ

SEQ ID NO: 762179 - protein, 158 aa, Homo sapiens
DIFIISPIKTLAIFRRSGNNHTLPSILNVEELERGTADPKNDGKGCEGDTLIANREMPDVKSIIVCPIRKYIVSSDPKRRARRLNVTFAEALQAGGGHSRSGGRRVGAGAGSWPGNRRGALRPLLGAHSRSTSDLSAVAQPGSCAGGGPGGALSGPPL

SEQ ID NO: 762180 - protein, 140 aa, Homo sapiens
EVWEPLPRFQRMYGNSWMSRQRCAADAQPSWRTSDGGVEKGNLRLEPLHRVCTGAWPSGVVKKGLPSFRSQTGRSIDSLHHMPGKAANTQCQPVKAARKRAVPCKTTGLELPQALGAHSCISVLGCEIWSRRRSFWNFKV

SEQ ID NO: 762181 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 762182 - protein, 137 aa, Homo sapiens
RLYSQKAAGGGPPKRACAPDMPRGAPLTARFESRDPLAEVAAAAWVPRRCPLPGSPFSRTTASLHSRTGPSWRAAPAPRSGWPRLASSTAPLRTSQTWPSVSSASRSWKAGSQMTTPCKSSLASLDGLCFELSCQKI

SEQ ID NO: 762183 - protein, 142 aa, Homo sapiens; identical to SEQ ID NO: 762181

SEQ ID NO: 762184 - protein, 142 aa, Homo sapiens; identical to SEQ ID NO: 762181

SEQ ID NO: 762185 - protein, 142 aa, Homo sapiens; identical to SEQ ID NO: 762181

SEQ ID NO: 762186 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAKKVRRAIEQLAAMD

SEQ ID NO: 762187 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 762188 - protein, 137 aa, Homo sapiens; identical to SEQ ID NO: 762187

SEQ ID NO: 762189 - protein, 142 aa, Homo sapiens; identical to SEQ ID NO: 762181

SEQ ID NO: 762190 - protein, 142 aa, Homo sapiens; identical to SEQ ID NO: 762181

SEQ ID NO: 762191 - protein, 142 aa, Homo sapiens; identical to SEQ ID NO: 762181

SEQ ID NO: 762192 - protein, 177 aa, Homo sapiens
RLYSQKAAGGGPPKRACAPDMPRGAPLTARFESRDPLAEVAAAAWVPRRCPLPGSPFSRTTASLHSRTGPSWRAAPAPRSGWPRLASSTAPCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 762193 - protein, 313 aa, Homo sapiens
MYVSYLLDKDVSMYPSSVRHSGGLNLAPQNFVSPPQYPDYGGYHVAAAAAAAANLDSAQSPGPSWPAAYGAPLREDWNGYAPGGAAAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQVKTRTKDKYRVVYTDHQRLELEKEFHYSRYITIRRKAELAATLGLSERQVKIWFQNRRAKERKINKKKLQQQQQQQPPQPPPPPPQPPQPQPGPLRSVPEPLSPVSSLQASVSGSVPGVLGPTGGVLNPTVTQ

SEQ ID NO: 762194 - protein, 313 aa, Homo sapiens; identical to SEQ ID NO: 762193

SEQ ID NO: 762195 - protein, 168 aa, Homo sapiens
AAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQGKQRLRPFGGCLGRRGSSQWLLRVARPVRTGASRAVWELGARRGTARRQIRGPLARRGFSDLLSLGVNILSLN

SEQ ID NO: 762196 - protein, 313 aa, Homo sapiens; identical to SEQ ID NO: 762193

SEQ ID NO: 762197 - protein, 313 aa, Homo sapiens; identical to SEQ ID NO: 762193

SEQ ID NO: 762198 - protein, 107 aa, Homo sapiens
MTQQAQCPLCKLQRGKQSPRPAGKRCSCLPPSRVGGLAGSMAGTRSLAAQNSSDWSPQGLWGQGPRDQLSPGVPLLLGWDLGHSHGSKLRELKVLAPPWGTLSSQQE

SEQ ID NO: 762199 - protein, 107 aa, Homo sapiens; identical to SEQ ID NO: 762198

SEQ ID NO: 762200 - protein, 107 aa, Homo sapiens; identical to SEQ ID NO: 762198

SEQ ID NO: 762201 - protein, 92 aa, Homo sapiens
MAPPETNSVPPARSGKLSGCGAGQRSLGRTAKRDAVASSSGRRLCLCPVPAVVWKATNLWSLFRENKNLWCIVPSNKGQPRLRSHNLLFIPE

SEQ ID NO: 762202 - protein, 99 aa, Homo sapiens
FCVTVREEVTTHPSWRREHDWLTSAPSPLFQISKALLGPQQDLSRCRDGVNVEWLVGDRVKLLESDGDLLISWVCASQQSPCVQEPGVSPCEGLGLVGQ

SEQ ID NO: 762203 - protein, 234 aa, Homo sapiens
EVRGGGEVLREAPGTMAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMVRG

SEQ ID NO: 762204 - protein, 489 aa, Homo sapiens
SWYGLEFGLPPLTPQPGPRLAGSGPSHWFSPLSLPVASKAPGTMAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 762205 - protein, 383 aa, Homo sapiens
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMVPEYCFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 762206 - protein, 446 aa, Homo sapiens
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 762207 - protein, 462 aa, Homo sapiens
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGYEAGDAQGPPAPQAPGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 762208 - protein, 133 aa, Homo sapiens
GGQSCRRVGGIWLRAGLGAELWRGRAGLPVNKPPACRCQSTVPCGADTGAPGAGHCRAARGLPWPPGDTGSPSSHPPRAAAGGGLHVTGAQRGAVRAGPAAGDQGPGSGEGGGPPWYILGQALAWRRVTEWGT

SEQ ID NO: 762209 - protein, 446 aa, Homo sapiens; identical to SEQ ID NO: 762206

SEQ ID NO: 762210 - protein, 446 aa, Homo sapiens; identical to SEQ ID NO: 762206

SEQ ID NO: 762211 - protein, 461 aa, Homo sapiens
EVRGGGEVLREAPGTMAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 762212 - protein, 383 aa, Homo sapiens; identical to SEQ ID NO: 762205

SEQ ID NO: 762213 - protein, 208 aa, Homo sapiens
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 762214 - protein, 108 aa, Homo sapiens
SQSLTLVAQAGVQWCNLGSLQPPPPRFKRFPCLSFSSSWDYRRASPCPDKFVFLVETGFLHVGQVGLELLTSSDPSASASQSAGITGVSHCTLPILHYLTKKDQLVRK

SEQ ID NO: 762215 - protein, 275 aa, Homo sapiens
STHASGPLDTSVTMWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTQEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 762216 - protein, 216 aa, Homo sapiens [sequence omitted]

SEQ ID NO: 762217 - protein, 123 aa, Homo sapiens
CPIPFSPSRLLIPPFPSFPSNYQLWLGRHNLFDDENTAQFVHVSESFPHPGFNMSLLENHTRQADEDYSHDLMLLRLTEPADTITDAVKVVELPTQEPEVGSTCLASGWGSIEPENCMWGQTV

SEQ ID NO: 762218 - protein, 275 aa, Homo sapiens; identical to SEQ ID NO: 762215

SEQ ID NO: 762219 - protein, 211 aa, Homo sapiens
MLPCPIPFSPSRLLIPPFPSFPSNYQLWLGRHNLFDDENTAQFVHVSESFPHPGFNMSLLENHTRQADEDYSHDLMLLRLTEPADTITDAVKVVELPTQEPEVGSTCLASGWGSIEPENFSFFETRAWIPQPRRMFMSSSDLYCLGTIGENKVESYLFKKYVSKNVLGHSGNLERQVFRALLFRNLPEDMAQSKAQDGFCCGPSKIKCASK

SEQ ID NO: 762220 - protein, 1288 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 762221 - protein, 194 aa, Homo sapiens
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTVYCWITFIDLRILNQPCIPGMKPT

SEQ ID NO: 762222 - protein, 432 aa, Homo sapiens
MFCLLSWEADSRGRLGEYTLQPLSLQTEETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 762223 - protein, 395 aa, Homo sapiens
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYYLTLSKVSPF

SEQ ID NO: 762224 - protein, 391 aa, Homo sapiens
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 762225 - protein, 1265 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPSLLESFMSLQDINLLERPPGRPQRPGNPLSNVSWRISEIAPTSHTDMSAGIKETAS

SEQ ID NO: 762226 - protein, 3406 aa, Homo sapiens
RTIGAAGSHVGAAGGGSSVGDAVVGAEKARAARRRGSGRGVDGAQRAAGVRRDRRRGGGPGRRQGPGRGPERRGQPKARTGAGGGGGRAGRREMMARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 762227 - protein, 385 aa, Homo sapiens
WLVEPGVIGEGGWMNVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 762228 - protein, 100 aa, Homo sapiens
IPRSLDLTGPLLLGGVPNLPENFPVSHKDFIGCMRDLHIDGRRVDMAAFVANNGTMAGRPEASTSLAHGPVPIIGRKWRTPYLTSSQSPLVASTMLQPRF

SEQ ID NO: 762229 - protein, 112 aa, Homo sapiens
TLAPVPPMTQTLIPRSLDLTGPLLLGGVPNLPENFPVSHKDFIGCMRDLHIDGRRVDMAAFVANNGTMAGRPEASTSLAHGPVPIIGRKWRTPYLTSSQSPLVASTMLQPRF

SEQ ID NO: 762230 - protein, 351 aa, Homo sapiens
QLLTSTKAPCSSHEVDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 762231 - protein, 3406 aa, Homo sapiens; identical to SEQ ID NO: 762226

SEQ ID NO: 762232 - protein, 3013 aa, Homo sapiens
RTIGAAGSHVGAAGGGSSVGDAVVGAEKARAARRRGSGRGVDGAQRAAGVRRDRRRGGGPGRRQGPGRGPERRGQPKARTGAGGGGGRAGRREMMARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGGVGAWGREEGGRGSLPIPFSSTPYWEQWLT

SEQ ID NO: 762233 - protein, 4366 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALAVNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKVGESGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLV

SEQ ID NO: 762234 - protein, 4366 aa, Homo sapiens; identical to SEQ ID NO: 762233

SEQ ID NO: 762235 - protein, 2180 aa, Homo sapiens
RRRKGNIAVNKKRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKVGESGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 762236 - protein, 2952 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALAVNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENDQILCICFIYLITVLNESFSKKNTKQKD

SEQ ID NO: 762237 - protein, 1194 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRVGTSLGTILPGPVVSPTACLLWPC

SEQ ID NO: 762238 - protein, 628 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSI

SEQ ID NO: 762239 - protein, 63 aa, Homo sapiens
MEIPPKQTLNVALQAYPNGALEPQTSNLDLQIMALTLRSPADPKSRPPELRTPPNPELNIRLP

SEQ ID NO: 762240 - protein, 4112 aa, Homo sapiens
MIDLTENTIIFTLNGEVLMSDSGSETAFREIEIGDGFLPVCSLGPGQVGHLNLGQDVSSLRFFAICGLQEGFEPFAIHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALAVNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKVGESGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 762241 - protein, 3616 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALAVNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKVGAWFWEEHLAERAGAPSRTSYLACPHPASPSWAQSLQSSEQPLLPPLPLPSSPAPSSSCIFSLLPSPSSSPSPSSLISVSFLLLYLLPPPIS

SEQ ID NO: 762242 - protein, 1939 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGASVEFQFVPVLKLVSTLLVMGIFGDEDVKQILKMIEPEVFTEEEEEEDEEEEGEEEDEEEKEESL

SEQ ID NO: 762243 - protein, 556 aa, Homo sapiens
LPRGCLWCLQRSPTPARPQPSRPARSPLPLFPDLRPWASDLDIMGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSYPPNHHSVCHTPTTAATPSESCREGSAPALAHTGTHSLPLLTCVCVCIHTTHTHMHKYVEQPSKAYATDSSCPSQNSAISRSPSVQSFYHKVAG

SEQ ID NO: 762244 - protein, 67 aa, Homo sapiens
MCHLLEYFCDQELQHRVESLAAFAERYVDKLQANQRSRYGLLIKAFSMTAAETARRTREFRSPPQEQ

SEQ ID NO: 762245 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 762246 - protein, 224 aa, Homo sapiens
SCSVTQAGVQWRDVCLLQPTPPSSSDSPASAFQVAGIQIVKMERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 762247 - protein, 270 aa, Homo sapiens
STGCPRHQPELGSFEKKTKRVTKYRTAECIHQSGSPESAFSNNHSVTYFLTPWDDKTQDTWLHSRLTDVHNGSEQERAKGEPQLYSLLVVGVTLDYQYPGDVEKKRGSFPTSHPATLGQKESCGKKSRVLVSRTLNLMVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 762248 - protein, 338 aa, Homo sapiens
ARSGASALRRRRVQVWVLSRPPPGGGDSFRTRRPQRGPGPWGSQAMDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 762249 - protein, 378 aa, Homo sapiens
AFTEPAGAGPGGQGWGARAAGPGLRLGAWPRGHPGGGSAAASTPATSRGRRRVRRTVKGPPGPHTPARSGACLAPATVSVSEKPAMDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 762250 - protein, 84 aa, Homo sapiens
PRWPGSPRRRPQRRSSQRRPQRNQTQRNRPQKNRPHREATAPEEVTKSQPEKWDEEAQDAAGEEEKEQEKEKDAENKVKNSKGT

SEQ ID NO: 762251 - protein, 367 aa, Homo sapiens
AEELGSVALSRLRQRRGTMASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 762252 - protein, 367 aa, Homo sapiens; identical to SEQ ID NO: 762251

SEQ ID NO: 762253 - protein, 336 aa, Homo sapiens
AEELGSVALSRLRQRRGTMASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDK

SEQ ID NO: 762254 - protein, 367 aa, Homo sapiens; identical to SEQ ID NO: 762251

SEQ ID NO: 762255 - protein, 271 aa, Homo sapiens
MASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKSIEQLEKELLNGQKLQGPETARELYSILQHKGLVDKFPLFMAVYKVCYEGQPVGEFIHCLQNHPEHM

SEQ ID NO: 762256 - protein, 116 aa, Homo sapiens
TEAKYNLFHAGGQKGARESSHLLLIWAIFLADLKMRPWWEAGLGPREEACQHCQPMSPGEKAGPSLCPIPVPHLSVPLSLLSLALPDSLSPWAPASPPTPGGRGLAAPTCGGVKCS

SEQ ID NO: 762257 - protein, 1269 aa, Homo sapiens
MDDPFSPCRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLPPTPLQASTRWPPNPRLLSTPLSLEALLPSPLRPAPPPLPHRRDLAPRPSHPALVRRLQEAAYAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762258 - protein, 1200 aa, Homo sapiens
SRSPVTGDGLLPPRTPGAYLWLLGSAARDQAGSPEKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762259 - protein, 1524 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762260 - protein, 1566 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762261 - protein, 1248 aa, Homo sapiens [sequence omitted]

SEQ ID NO: 762262 - protein, 1227 aa, Homo sapiens
GPLAFVFPVGFCDTGAFRCLLEILWIKESGLLTPYGSLLEKSHRVWFCFPFLLDTSGKLGSQKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762263 - protein, 1275 aa, Homo sapiens
SNTGSGRDPLPGGQVIYWLGSFRGDLVVKRRPGKCRLMPGPPGRGRPQSRAGRDRGGRRGQPPVSQLRRGWGGGRAAGAQPTSSIRNVGWRPSSLEGPQPCGRPLPTLAAKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762264 - protein, 1200 aa, Homo sapiens; identical to SEQ ID NO: 762258

SEQ ID NO: 762265 - protein, 1200 aa, Homo sapiens; identical to SEQ ID NO: 762258

SEQ ID NO: 762266 - protein, 1200 aa, Homo sapiens; identical to SEQ ID NO: 762258

SEQ ID NO: 762267 - protein, 1566 aa, Homo sapiens; identical to SEQ ID NO: 762260

SEQ ID NO: 762268 - protein, 103 aa, Homo sapiens
MDRGLDRGLVTAASIQGLQGRCYRLCFLPGVSLVSAPSLCSASSTDICSIRPLPFCTGSAGGECSLSVLQCHCSVSTGWKAHGPVSIVDFLLDFCVHTLDCSG

SEQ ID NO: 762269 - protein, 650 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKVRCWGDSRAYSVPPSH

SEQ ID NO: 762270 - protein, 521 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTSKWPRHAP

SEQ ID NO: 762271 - protein, 216 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGVRRIPFLKAISILYPIGYKIGILPPSPEPLLKCAVLYVFLKE

SEQ ID NO: 762272 - protein, 1566 aa, Homo sapiens; identical to SEQ ID NO: 762260

SEQ ID NO: 762273 - protein, 173 aa, Homo sapiens
SNTGSGRDPLPGGQVIYWLGSFRGDLVVKRRPGKCRLMPGPPGRGRPQSRAGRDRGGRRGQPPVSQLRRGWGGGRAAGAQPTSSIRNVGWRPSSLGRAPALWAPSPHACCGREEVSVLYRLDVLLSGRRTQIPAPGALEAPASGWGSGRGRGRGRGAGPRLADRRAAAIQAAF

SEQ ID NO: 762274 - protein, 1566 aa, Homo sapiens; identical to SEQ ID NO: 762260

SEQ ID NO: 762275 - protein, 1385 aa, Homo sapiens [sequence omitted]

SEQ ID NO: 762276 - protein, 1227 aa, Homo sapiens
SRSPVTGDGLLPPRTPGAYLWLLGSAARDQAGSPEGSLLEKSHRVWFCFPFLLDTSGKLGSQKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762277 - protein, 1200 aa, Homo sapiens; identical to SEQ ID NO: 762258

SEQ ID NO: 762278 - protein, 1657 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQVRFAAEPCCVKLMLLQKPPAGVLPSWWPCPVSYGGAGVAFDTGWVRARPVVPEPSLLLHLHKHYCVSGTGGAEQTGLCPPGTSILPFSGLQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762279 - protein, 834 aa, Homo sapiens
MLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 762280 - protein, 1200 aa, Homo sapiens; identical to SEQ ID NO: 762258

SEQ ID NO: 762281 - protein, 1566 aa, Homo sapiens; identical to SEQ ID NO: 762260

SEQ ID NO: 762282 - protein, 697 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSVSPLGPWGSWQLLQFPGMCGGLSLPGGGSESLVYQTKSWRGAALPEAVACLWAGKSSLFSPSRGPRVASCSGFCSKLLASGSVQALQGPSCSPRLLLVVSLPLYQISAILNLQALLC

SEQ ID NO: 762283 - protein, 230 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNC

SEQ ID NO: 762284 - protein, 162 aa, Homo sapiens
AGSRARGRRVRERGAAGCECVGVRVCGSGVREKLTGREAVRNWASVRGRPASLREPQSAEEKGGGSRYPDPLPLLSFPHFQPPGGPRFLEGPSPAQSAESEGGAPRPRGAGVCLSGRGAVCDSENRAKKGNSKFSHRQSSTRSRATFLFLPCPPAGGKELSV

SEQ ID NO: 762285 - protein, 244 aa, Homo sapiens
YPIEHGIVTNWDDMEKIWHHTFYNELRVAPEEHPVLLAARPLSLKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNC

SEQ ID NO: 762286 - protein, 230 aa, Homo sapiens; identical to SEQ ID NO: 762283

SEQ ID NO: 762287 - protein, 70 aa, Homo sapiens
DPGEDVALPSVSFEDTEATLGVPPSCTCHLELSMHLEAPQLFISQLFQEEDVSLITFLKYATCSPTRCST

SEQ ID NO: 762288 - protein, 70 aa, Homo sapiens; identical to SEQ ID NO: 762287

SEQ ID NO: 762289 - protein, 327 aa, Homo sapiens
DPGEDVALPSVSFEDTEATQVSPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGMPREQRCLQPVGASPGLCSCKNWLQAAPAPEELAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 762290 - protein, 180 aa, Homo sapiens
DPGEDVALPSVSFEDTEATQVSPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKFQEAAFANGKL

SEQ ID NO: 762291 - protein, 171 aa, Homo sapiens
HSPPPSPPLCLGCTPRAAVSCLQPVGASPGLCSCKNWLQAAPAPEELAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 762292 - protein, 70 aa, Homo sapiens; identical to SEQ ID NO: 762287

SEQ ID NO: 762293 - protein, 70 aa, Homo sapiens; identical to SEQ ID NO: 762287

SEQ ID NO: 762294 - protein, 342 aa, Homo sapiens
DPGEDVALPSVSFEDTEATQVSPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKPAGPPFSSSFHLLHQGMPREQRCLQPVGASPGLCSCKNWLQAAPAPEELAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 762295 - protein, 70 aa, Homo sapiens; identical to SEQ ID NO: 762287

SEQ ID NO: 762296 - protein, 70 aa, Homo sapiens; identical to SEQ ID NO: 762287

SEQ ID NO: 762297 - protein, 104 aa, Homo sapiens
MWSFASPWEKIWPSFRWTYLMPFRAQTQDTKLSLDLSVRPKDCLEKFEGSVYLDWHMHPLSLNIRRESREISSFLSRKKVSTNRSGGKRPIGEGIRVRGEKEKR

SEQ ID NO: 762298 - protein, 120 aa, Homo sapiens
MEGSRPSPVSLRGGAHRPACRGGPAPSLPAGDPRRPRPPAHAVLHLGASTNAGGCAALQPLRPRPLGPADHQAALLGPRLLRASHLLLASVGSDCGAHGAWGHGFLLGPQMPFLEWLSLS

SEQ ID NO: 762299 - protein, 87 aa, Homo sapiens
RSLLPSESDIITEEDKSKKKGQEEKQPKKQPKKDEEGQKEEDKPRKEPDKKEGKKEVESKRKNLAKTGVTSTSDSDGSKMAQSNKTT

SEQ ID NO: 762300 - protein, 622 aa, Homo sapiens
RRQRRRGCDSEPLRRLCGSWWRRWLAWTRVEATGQQPQRRRPRPRQARRDAPRHPPPPAGPVAGPASAARIPAPPHLLAASRASDPRSRPRNMTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 762301 - protein, 612 aa, Homo sapiens
RRQRRRGCDSEPLRRLCGSWWRRWLAWTRVEATGQQPQRRRPRPRQARRDAPRHPPPPAGPVAGPASAARIPAPPHLLAASRASDPRSRPRNMTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGENAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 762302 - protein, 622 aa, Homo sapiens; identical to SEQ ID NO: 762300

SEQ ID NO: 762303 - protein, 622 aa, Homo sapiens; identical to SEQ ID NO: 762300

SEQ ID NO: 762304 - protein, 229 aa, Homo sapiens
MLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 762305 - protein, 622 aa, Homo sapiens; identical to SEQ ID NO: 762300

SEQ ID NO: 762306 - protein, 622 aa, Homo sapiens; identical to SEQ ID NO: 762300

SEQ ID NO: 762307 - protein, 622 aa, Homo sapiens; identical to SEQ ID NO: 762300

SEQ ID NO: 762308 - protein, 622 aa, Homo sapiens; identical to SEQ ID NO: 762300

SEQ ID NO: 762309 - protein, 603 aa, Homo sapiens
RRQRRRGCDSEPLRRLCGSWWRRWLAWTRVEATGQQPQRRRPRPRQARRDAPRHPPPPAGPVAGPASAARIPAPPHLLAASRASDPRSRPRNMTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKK

SEQ ID NO: 762310 - protein, 622 aa, Homo sapiens; identical to SEQ ID NO: 762300

SEQ ID NO: 762311 - protein, 622 aa, Homo sapiens; identical to SEQ ID NO: 762300

SEQ ID NO: 762312 - protein, 609 aa, Homo sapiens
RRQRRRGCDSEPLRRLCGSWWRRWLAWTRVEATGQQPQRRRPRPRQARRDAPRHPPPPAGPVAGPASAARIPAPPHLLAASRASDPRSRPRNMTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKNTSEEKS

SEQ ID NO: 762313 - protein, 68 aa, Homo sapiens
MRTSYLLLFTLCLLLSEMASGGNFLTGLGHRSDHYNCVSSGGQCLYSACPIFTKIQGTCYRGKAKCCK

SEQ ID NO: 762314 - protein, 68 aa, Homo sapiens; identical to SEQ ID NO: 762313

SEQ ID NO: 762315 - protein, 68 aa, Homo sapiens
KRTFAEKAANEFRLHSSQNLMFCNDDISVAAEGPSPESLRSARRFERRDNGRSVRPRPLQAICIPRSA

SEQ ID NO: 762316 - protein, 554 aa, Homo sapiens
MGPLTFRDVKIEFSLEEWQCLDTAQRNLYRDVMLENYRNLVFLVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 762317 - protein, 586 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 762318 - protein, 517 aa, Homo sapiens
MVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 762319 - protein, 281 aa, Homo sapiens
MGPLTFRDVKIEFSLEEWQCLDTAQRNLYRDVMLENYRNLVFLVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNQSSIFTKHKIIHTEGKSYKCEKCGNAFNQSSNLTARKIIYTEENPKALVAQTLFDIREFVLEKNPANVINMEKHFFKNYSLENIREFILKYIFADAVNMKNI

SEQ ID NO: 762320 - protein, 510 aa, Homo sapiens
MCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 762321 - protein, 230 aa, Homo sapiens
MCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 762322 - protein, 269 aa, Homo sapiens
MVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 762323 - protein, 535 aa, Homo sapiens
KRRVSMAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 762324 - protein, 213 aa, Homo sapiens
AVVSTQSAHYGREMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 762325 - protein, 561 aa, Homo sapiens
KRRVSMAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKGQIRVAKRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 762326 - protein, 561 aa, Homo sapiens; identical to SEQ ID NO: 762325

SEQ ID NO: 762327 - protein, 446 aa, Homo sapiens
GRLLLLNSRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 762328 - protein, 561 aa, Homo sapiens; identical to SEQ ID NO: 762325

SEQ ID NO: 762329 - protein, 1141 aa, Homo sapiens
MAVPGDAARVRNKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEATASLPTSWQTLLFHQTCATSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 762330 - protein, 1141 aa, Homo sapiens; identical to SEQ ID NO: 762329

SEQ ID NO: 762331 - protein, 237 aa, Homo sapiens
MGNRHSQSYTLSEGSQQLPKGDSQPSTVVQPLSHPSRNGEPEAPQPAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRMKGCRGQDQPGRCPICLIREGRGQINSVRVGQGPGR

SEQ ID NO: 762332 - protein, 316 aa, Homo sapiens
MGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 762333 - protein, 357 aa, Homo sapiens
MGNRHSQSYTLSEGSQQLPKGDSQPSTVVQPLSHPSRNGEPEAPQPAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 762334 - protein, 229 aa, Homo sapiens
MIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 762335 - protein, 420 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERSH

SEQ ID NO: 762336 - protein, 229 aa, Homo sapiens; identical to SEQ ID NO: 762334

SEQ ID NO: 762337 - protein, 503 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 762338 - protein, 544 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLIYRVSLVLPRPECMVRSGLTETSTSWVRVILLPQPPEELGITALFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 762339 - protein, 402 aa, Homo sapiens
MDLIPNFAMETWVLVATSLVLLYIYGTHSHKLFKKLGIPGPTPLPFLGTILFYLRGLWNFDRECNEKYGEMWGFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 762340 - protein, 104 aa, Homo sapiens
MVQKRPALQPLCQLWKRKAERISRPDSRSPEGQLLQQTHQCSTSGQTQQPTMCSPPASHFCLTRALTLGILSLFCRHRNGCYSAGKERTPDLTPDVLAPNPLCL

SEQ ID NO: 762341 - protein, 882 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762342 - protein, 823 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRADIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762343 - protein, 882 aa, Homo sapiens; identical to SEQ ID NO: 762341

SEQ ID NO: 762344 - protein, 691 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762345 - protein, 935 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKEVCLSLARGWRQGLTWDRTQRPRVCCHLTPGPLSITFSSQLGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762346 - protein, 413 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLARNSTSPTGPRTLTASGA

SEQ ID NO: 762347 - protein, 417 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDCPGLDGG

SEQ ID NO: 762348 - protein, 914 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRAIICEKEHCMATEGQQLRQPKTETFEQGLEGCAGVRQQSQAGQDLSWQLSCCCFHVFWVQRSWLHRSEP

SEQ ID NO: 762349 - protein, 809 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDGQSPECLRVWQWNF

SEQ ID NO: 762350 - protein, 224 aa, Homo sapiens
MHLGCGAGHPGDGACPEQEEEEVWRLPVHGPELPGVQRHHEEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762351 - protein, 196 aa, Homo sapiens
MDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762352 - protein, 182 aa, Homo sapiens
TLGRGSVDRPSVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762353 - protein, 377 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTECPGLDGG

SEQ ID NO: 762354 - protein, 150 aa, Homo sapiens
FSCGWDNGTLSAGAGGEEPSPIPGLHAASLTRFPSYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762355 - protein, 882 aa, Homo sapiens; identical to SEQ ID NO: 762341

SEQ ID NO: 762356 - protein, 894 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWLSDRVSRPSMLGDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762357 - protein, 697 aa, Homo sapiens
MGRETKETCSIKLTPSLLSRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762358 - protein, 358 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTEGP

SEQ ID NO: 762359 - protein, 801 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGA

SEQ ID NO: 762360 - protein, 382 aa, Homo sapiens
VPYQSSNACAGRSAAVFRAAKYETFKLLKLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWLSDRVSRPPCSGDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762361 - protein, 204 aa, Homo sapiens
GWYGPGFEDQRAARMAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKEGP

SEQ ID NO: 762362 - protein, 198 aa, Homo sapiens
MPDMAALLSFNAANNLTRGSGEETGPKRQPALQGFPSTAAVPTPSPAGDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 762363 - protein, 135 aa, Homo sapiens [sequence omitted]

SEQ ID NO: 762364 - protein, 242 aa, Homo sapiens
REAIPGQRVVGRRARASARTEPRDPGRTGEGPLRAAARGQRGAAGTWHRAGPAAATMIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVLVLGNKRDLPGALDEKELIEKMNLSAIQDREICCYSISCKEKDNIDITLQWLIQHSKSRRS

SEQ ID NO: 762365 - protein, 234 aa, Homo sapiens
TRLASGIPGIRTEPRDPGRTGEGPLRAAARGQRGAAGTWHRAGPAAATMIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVLVLGNKRDLPGALDEKELIEKMNLSAIQDREICCYSISCKEKDNIDITLQWLIQHSKSRRS

SEQ ID NO: 762366 - protein, 206 aa, Homo sapiens
REAIPGQRVVGRRARASARTEPRDPGRTGEGPLRAAARGQRGAAGTWHRAGPAAATMIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVSRPEGAGWGGSSAGKSLGAGKSQAW

SEQ ID NO: 762367 - protein, 203 aa, Homo sapiens
REAIPGQRVVGRRARASARTEPRDPGRTGEGPLRAAARGQRGAAGTWHRAGPAAATMIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPESVCHPGPRDLLLLHLLQRKGQH

SEQ ID NO: 762368 - protein, 242 aa, Homo sapiens; identical to SEQ ID NO: 762364

SEQ ID NO: 762369 - protein, 242 aa, Homo sapiens; identical to SEQ ID NO: 762364

SEQ ID NO: 762370 - protein, 242 aa, Homo sapiens; identical to SEQ ID NO: 762364

SEQ ID NO: 762371 - protein, 242 aa, Homo sapiens; identical to SEQ ID NO: 762364

SEQ ID NO: 762372 - protein, 242 aa, Homo sapiens; identical to SEQ ID NO: 762364

SEQ ID NO: 762373 - protein, 242 aa, Homo sapiens; identical to SEQ ID NO: 762364

SEQ ID NO: 762374 - protein, 242 aa, Homo sapiens; identical to SEQ ID NO: 762364

SEQ ID NO: 762375 - protein, 242 aa, Homo sapiens; identical to SEQ ID NO: 762364

SEQ ID NO: 762376 - protein, 242 aa, Homo sapiens; identical to SEQ ID NO: 762364

SEQ ID NO: 762377 - protein, 160 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKVMGMGRRRHTEAGAFESELTGRATQSPLISVPSAWYTIPLPCFRPNPSHRFQPRCCLL

SEQ ID NO: 762378 - protein, 74 aa, Homo sapiens
PRVRGVVSEDDAAWQELHRRGRLHLPREEEGHSGLGLWDPEHSTEPGCREGLRLLLSLPAALPRSCCHPRWLPV

SEQ ID NO: 762379 - protein, 69 aa, Homo sapiens
CRLVLVARCYDPQSCHCPFLPRMTRHGKNCTAGAVYTYHEKKKDTGLRLLLSLPAALPRSCCHPRWLPV

SEQ ID NO: 762380 - protein, 81 aa, Homo sapiens
CRLVLVARCYDPQSCHCPFLPRMTRHGKNCTAGAVYTYHEKKKDTAASGYGTQNIRLSRDAVKDFDCCCLSLQPCHDPVVT

SEQ ID NO: 762381 - protein, 312 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGVPASRLTEEAHKRMTAE

SEQ ID NO: 762382 - protein, 153 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHMMSNLGPVWVLQVRTRTKCCPASGSRR

SEQ ID NO: 762383 - protein, 80 aa, Homo sapiens
RTVEEATEGLGVVSEDDAAWQELHRRGRLHLPREEEGHSGLGLWDPEHSTEPGCREGLRLLLSLPAALPRSCCHPRWLPV

SEQ ID NO: 762384 - protein, 249 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPKLRGPRGAHHPQRALRVCRDPRQPEQRHPLRCAAALWGCGHPRMRGEADSEGHGGPCDWRQTHRPRHHRAAAGRYRRSRAPE

SEQ ID NO: 762385 - protein, 98 aa, Homo sapiens
CRLVLVARCYDPQSCHCPFLPRMTRHGKNCTAGAVYTYHEKKKDTGCRAGVGRGGTWLCLGVTLSPRAPGFASSVPVSLPPPIYTDGHDHVNNSWVIP

SEQ ID NO: 762386 - protein, 80 aa, Homo sapiens; identical to SEQ ID NO: 762383

SEQ ID NO: 762387 - protein, 98 aa, Homo sapiens; identical to SEQ ID NO: 762385

SEQ ID NO: 762388 - protein, 98 aa, Homo sapiens; identical to SEQ ID NO: 762385

SEQ ID NO: 762389 - protein, 110 aa, Homo sapiens
SGQLKKRPRDWESLVRMTRHGKNCTAGAVYTYHEKKKDTAASGYGTQNIRLSRDAVKDFDCCCLSLQPCHDPVVTPTRSSGAPGARSRRSFSGRPRRTMCGASWRRSRLS

SEQ ID NO: 762390 - protein, 281 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLTDSEGHGGPCDWRQTHRPRHHRAAAGRYRRSRAPE

SEQ ID NO: 762391 - protein, 241 aa, Homo sapiens
SGQLKKRPRDWESLVRMTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPWGCGHPRMRGEADSEGHGGPCDWRQTHRPRHHRAAAGRYRRSRAPE

SEQ ID NO: 762392 - protein, 301 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 762393 - protein, 112 aa, Homo sapiens
CFSWYKVLMILIFKKKVKIITYLIQILTYAKNNKCISFKLRSNSDVFLQENYFHFSVISLLSNPRAKFILRMTFKRKAKRAFIHYITTLLTSLKHSLCLIIFRLIIHYQIKE

SEQ ID NO: 762394 - protein, 130 aa, Homo sapiens
MSGRGKQGGKARAKAKSRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 762395 - protein, 135 aa, Homo sapiens
MSGRGKQGGKARAKAKSRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGLITLGS

SEQ ID NO: 762396 - protein, 130 aa, Homo sapiens; identical to SEQ ID NO: 762394

SEQ ID NO: 762397 - protein, 130 aa, Homo sapiens; identical to SEQ ID NO: 762394

SEQ ID NO: 762398 - protein, 790 aa, Homo sapiens
STVCCGQCYCGDRQSSLRAMEEPGATPQPYLGLVLEELRRVVAALPESMTADSNPYGFPWELVVCAAVVGFFVVLLFLWRSFRSVRSRLYVGREKKLGETLSGLIEEKCKLLEKFSLIQKEYEGYEVESSLEDASFEKAVAEARSLEATCEKLNRSNSELEDETLCLEKELRKSKHSQQDELMADISKRIQSLEDESKSLKSQIAEAKIICKIFQATEERWAIAIKDALNKNSQLHESQKQLLQEAEVWKEQVSELNKQKITFEDSKVHAEQVLNDKIIIKTLTGHLPMMNDQAAVLEEDTTDDDNLELEVNSQSENGAYLDDPPKGALKKLIHAAKLNVSLKTLEGERNHIIIQLSEVDKTKEELTEHIKNLQTQQASLQSENIYFESENQKLQQKLKIMTELYQENEMTLHRKLTIEENYWIEEEEKLSKVEEKISHATEELETYRKLAKDLEEELERTVHFYQKQVISYEKKGHDNWLAARTAERNLNDLRKENAHNKQKLTETEFKFEVLEKDPNALDVSNTASGREHSPYGPSPLGRPSSETRTSLSSNFVGGSTQTLTCASSGRRKKPKGRENPLDHQITNERGEPSCDRLTDPHRAPSDTGSLSSPWEQDHRMMFPPPGQSYPDSALPPQREDRFYSNSDRLPGPSELRSFNMPSLDKMDGSMPSEMESTRHDAKDDPGSLNVPDSSLPAENEATGPGFIPPPLAPISGPLFPVDTRCPFMRRGPLFPQPPPGTMFGASQGYFPPRDFPGPPHVPFAMRNICPLRGLPPYFHPRPGFYPNPTF

SEQ ID NO: 762399 - protein, 381 aa, Homo sapiens
IFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVRVDYQVVCFLHISIVNSLMSYPLSFSISTPVYYILYIHFICIYAIIAMHCLPAFVN

SEQ ID NO: 762400 - protein, 373 aa, Homo sapiens
IFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKKDLWSSSPISMGLDPTNMSAASS

SEQ ID NO: 762401 - protein, 358 aa, Homo sapiens
GARSPTPREGARGASPALGVGRAPGRSEGPGGGRRSPDAGCANTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGKRSFLVHKFSSLF

SEQ ID NO: 762402 - protein, 212 aa, Homo sapiens
VRGSSAAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762403 - protein, 1142 aa, Homo sapiens
GARSPTPREGARGASPALGVGRAPGRSEGPGGGRRSPDAGCANTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762404 - protein, 1183 aa, Homo sapiens
SVLCWNVRLPRARGAAAERAPPRPGAPDPGGGCGSRDGRARPGGLSTLCSPTPGPSWSTTAPAPNFTTLPHLSPETPATKKSSRRRSGDSGSPAPPHRGRPNTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLVEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762405 - protein, 1113 aa, Homo sapiens
LNTLPIHISITWPNTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762406 - protein, 1201 aa, Homo sapiens
SVLCWNVRLPRARGAAAERAPPRPGAPDPGGGCGSRDGRARPGGLSTLCSPTPGPSWSTTAPAPNFTTLPHLSPETPATKKSSRRRSGDSGSPAPPHRGRPNTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762407 - protein, 1159 aa, Homo sapiens
GARSPTPREGARGASPALGVGRAPGRSEGPGGGRRSPDAGCANTVMATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSVGYGYHLVIFTESVIQMGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 762408 - protein, 130 aa, Homo sapiens
KRTTVTPGYSPMSPRTPPWTGGEAPSWPRDWPRGGPLDPRPALCSPAPSEGSRCTSQNVSEGDKERDLCLRRCVCVVRFSSRKGDKSKARLWIVGLSEGVQIYPRRSELGCSRWAVGKKPAWKKEGRKLW

SEQ ID NO: 762409 - protein, 130 aa, Homo sapiens; identical to SEQ ID NO: 762408

SEQ ID NO: 762410 - protein, 396 aa, Homo sapiens [sequence omitted]

SEQ ID NO: 762411 - protein, 396 aa, Homo sapiens [sequence omitted]

SEQ ID NO: 762412 - protein, 333 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGK

SEQ ID NO: 762413 - protein, 333 aa, Homo sapiens; identical to SEQ ID NO: 762412

SEQ ID NO: 762414 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 762415 - protein, 420 aa, Homo sapiens; identical to SEQ ID NO: 762414

SEQ ID NO: 762416 - protein, 335 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGFSR

SEQ ID NO: 762417 - protein, 439 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEVLCIFIYILDSADNFLQKKKAGSSETEIEVICYIEKPGVETLEDSVF

SEQ ID NO: 762418 - protein, 143 aa, Homo sapiens
MPPKPRGLPRCPPCQSVWPLPGPGWLQVVGLPFPLPFPGLSQAQSPCFSFPVWGDRRVATEPGSALGAAGLQTWLWSCSPGEGGGPGEDELPNTCYGSFQSQAARTQSQRSIRWGWGHVGWPWLSQVGSCQAKSYAKWGPPWP

SEQ ID NO: 762419 - protein, 143 aa, Homo sapiens; identical to SEQ ID NO: 762418

SEQ ID NO: 762420 - protein, 515 aa, Homo sapiens
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEES

SEQ ID NO: 762421 - protein, 515 aa, Homo sapiens; identical to SEQ ID NO: 762420

SEQ ID NO: 762422 - protein, 86 aa, Homo sapiens
TGRADGVMWRGQEQGVGASPKLLNNQISRELTKQELTYHRGDGARPFMTDLSPRSSHLPPDPTSNVGIPFPHEIWRGQTSKPYHRH

SEQ ID NO: 762423 - protein, 110 aa, Homo sapiens
MSHAVSPFRKCKRLGRKCQRTSCVEKVSLVVKPLSVCVCVSPDLCTYWATGKMHFVGQNIWRNTFLLSLTGSVFSVSKLLCTLRGRVETLQQVLSVCSLQISPQDKSSCS

SEQ ID NO: 762424 - protein, 47 aa, Homo sapiens
CLPDEEMAVLRSHWSRSRRWHVTARVQNVLTKSNAPHPRPGTSRYRL

SEQ ID NO: 762425 - protein, 4366 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCT

SEQ ID NO: 762426 - protein, 400 aa, Homo sapiens
MLDPPGTLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFIIINTLTTTIFLGTAYDALSPELYTTYFVTKTLLLTSLFFMNSNSIPPIPLYDLGILKET

SEQ ID NO: 762427 - protein, 398 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFIIINTLTTTIFLGTAYDALSPELYTTYFVTKTLLLTSLFLMNSNSIPPIPLYDLGILKET

SEQ ID NO: 762428 - protein, 519 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASGKAPYTPLLDQQI

SEQ ID NO: 762429 - protein, 729 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSITYAAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 762430 - protein, 89 aa, Homo sapiens
PKLPPPQAQDLHRQRDGGRMELVELWGPLDLLALAAQKQWKRNHPTLSSFCFLQMIFGDLMRFCWLMAVVILGFASGKAPYTPLLDQQI

SEQ ID NO: 762431 - protein, 540 aa, Homo sapiens
MDETAEQNSSLAVGLNDQLHDLSRSRSPAARSSASNIRERRARIARGRWDRVPDVATRRGLLRPAVSGKVRGRRRPSNVGFGNCSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMITKEHIKNIRDMNTEAETLAIILHASQHWIHAEICDNRSRGLEQVNTGPKHSLGNGHRIAMRLSQHGGPAEEISEGINPCVAAKHPAQCPRDILSGEPVFTGALGDSNSDRDW

SEQ ID NO: 762432 - protein, 483 aa, Homo sapiens
MHRGGQPLKKRRGSFKMAELDQLPDESSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMITKEHIKNIRDMNTEAETLAIILHASQHWIHAEICDNRSRGLEQVNTGPKHSLGNGHRIAMRLSQHGGPADEISEGINPCVAAKHPAQCPRDILSGEPVFTGALGDSNSDRDW

SEQ ID NO: 762433 - protein, 574 aa, Homo sapiens
PACCLPSGCTGRDGRPCPPLGRWADCQPHCGPLVLPLRCCRRVAAFVMVSVCWFLGLCERQGRKPRARESSLCQAEAVAAPLAPLRPPAEVEGRAAPGRGGCPRRLHHSPGAERRRRGSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMITKEHIKNIRDMNTEAETLAIILHASQHWIHAEICDNRSRGLEQVNTGPKHSLGNGHRIAMRLSQHGGPAEEISEGINPCVAAKHPAQCPRDILSGEPVFTGALGDSNSDRDW

SEQ ID NO: 762434 - protein, 448 aa, Homo sapiens
MHRGGQPLKKRRGSFKMAELDQLPDESSSAKALVSLKEGSLSNTWNEKYSSLQKTPVWKGRNTSSAVEMKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMITKEHIKNIRDMNTEAETLAIILHASQHWIHAEICDNRSRGLEQVNTGPKHSLGNGHRIAMRLSQHGGPAEEISEGINPCVAAKHPAQCPRDILSGEPVFTGALGDSNSDRDW

SEQ ID NO: 762435 - protein, 242 aa, Homo sapiens
FLTEFYELILKRLTILLSHFFPFSRMGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWSEN

SEQ ID NO: 762436 - protein, 273 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 762437 - protein, 122 aa, Homo sapiens
MTPHQHSRTSEKYPNADLIMNYCRNPDPVEGPWCYTMDPKVRWEYCNLTRCSDTEGTAVVPLTVIPVPSLEDPSKPAPTEPRPWEQQCYHGNGQSYRGTYFTTVTGRTCQAWSSMTPHQHMA

SEQ ID NO: 762438 - protein, 119 aa, Homo sapiens
MNYCRNPDPVEGPWCYTMDPKVRWEYCNLTRCSDTEGTAVVPLTVIPVPSLEDPSKPGKKSVARHLHTWTLGRKAFETPIVAEAFSATHVLTCWLMVCHVGRILRALWGGARRVIFGAT

SEQ ID NO: 762439 - protein, 122 aa, Homo sapiens; identical to SEQ ID NO: 762437

SEQ ID NO: 762440 - protein, 122 aa, Homo sapiens; identical to SEQ ID NO: 762437

SEQ ID NO: 762441 - protein, 617 aa, Homo sapiens [sequence omitted]

SEQ ID NO: 762442 - protein, 817 aa, Homo sapiens
GRQGWCCTGRCFPSPFLASFLTRRRPQFWRVCHSLPVVGDQRPGVLGSGERCSAQDRKGVRARVPQIPGNPRHPPAPAHPRPRCQSPLALTGSRRSGPGAGLMQSARYLGRRLHYQPGPRQARPEPVSPRPAGRPAPPALPRAPPERHTAEPSPSPRPRACQGAAASGAGRAQGTRDPLAAGHSLGVPPGPVKFLSPAASMLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 762443 - protein, 772 aa, Homo sapiens
GRQGWCCTGRCFPSPFLASFLTRRRPQFWRVCHSLPVVGDQRPGVLGSGERCSAQDRKGVRARVPQIPGNPRHPPAPAHPRPRCQSPLALTGSRRSGPGAGLMQSARYLGRRLHYQPGPRQARPEPVSPRPAGRPAPPALPRAPPERHTAEPSPSPRPRACQGAAASGAGRAQGTRDPLAAGHSLGVPPGPVKFLSPAASMLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 762444 - protein, 459 aa, Homo sapiens
MDEAGVNRTSLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 762445 - protein, 488 aa, Homo sapiens
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYEYGLMPQLRYFFPWGLDLEYVIAFASYNKFDNNCYRDALLTSSINCITSFVSGFAIFSILGYMAHEHKVNIEDVATEDGRHGGCHHGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 762446 - protein, 617 aa, Homo sapiens [sequence omitted]

SEQ ID NO: 762447 - protein, 512 aa, Homo sapiens
MGVQWWSHTQGEVAVGLGLGDSYLTPCPCPGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 762448 - protein, 696 aa, Homo sapiens
MAFPRKLFIKETGAKDVRALLQRALIEVKALREVKLGILCETEGTTHSRTEKAPQMSPLQSALRTLSLGIWVGLTSTRGSQKGEGRGLRQATLAHVQASEGSEAQAEVKVRIPNESKRTTHLRSMPRAFSPKKPDPCSQSWEALNRVDRMRCVLTSASEGLGEVRVLVKVREPRAAEGEGANPSSSQGEEGYGGESHQALVCSSLSARTWMSSICELSFSYLMIPGAEVLGLEWAGDRGAKVSKGRSTMPFRESTAEACVISEGPLISEEYRSTKPAPAIKLRKPWARLTSSRGSQRCEGLGLREEYSSQQRKAAKVQPGIKVSALHEDWRNPCSTGTLGCLCTDYMTCTHFLLWYGGVFGNDGEGFCLKYDGLRSAVGGFPGITRNKGEDMVSEGNTKFIPYSQPWKTTVQVRWYPYLTRESQENLVGIEKPWAMPRDKGRVGRTTHHWIDNKASVPHPCTQYLKDQGRTIRLRLLPTSLYIENLRQMKSLVYDCSHQSAKGKSSRNYLEIRWIPRMRTEDPSISGQRDLHIAPSWVPSDRDGGLRSSFTLSSGVSGRCWLWFEVSTSEQQKGGEPGPANNGYDDYDYELRPPHSITENPHYQPLPPSQYTYGRVGRLQPKTHSNFIHRVLSGEADQENRSSMGFLKQCSWKPVAVAFVKAMVVSPCCWCSHHLILPPSGAHIASHPVHTFSYSA

SEQ ID NO: 762449 - protein, 106 aa, Homo sapiens
KYCGPWVFWGALYPSPTPTPTHLWWGSWSPVMSQCLQMVEKVSKGGPGAILHTTPTGEGGSCLPSLEKTPGEAPIAWLRSQFILEPITAARGICALSTWVSDPPLS

SEQ ID NO: 762450 - protein, 743 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762451 - protein, 814 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSDILVAPGSPRETEKGQYLEHLGNDMAKDSTERPDNAEGLQIEDPECLGWSLLGGMELTLGSVLPDLLSSTQGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762452 - protein, 726 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQVSSVAERLGFRIRLIRVV

SEQ ID NO: 762453 - protein, 343 aa, Homo sapiens
MLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762454 - protein, 289 aa, Homo sapiens
ITLDWVQGFDEGGGVIETCRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762455 - protein, 349 aa, Homo sapiens
PASASGVAGITGARHTWITVTLLVEMGFHHVGQAGLKLLTSGDPPASASQSAGITGVSHHARPDCSHFLTSLCTPLMALFLFFLWSLALLPILECSSVTLAHRDLHVPGLSSSVSASQIAGTLGVHHHAQLIFFCLFSRDGVSLCWPGWSQSPDLRCSTRLGLPKCWDYRCEPPRPAMECILFYVSTSYILSPGWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762456 - protein, 203 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGYSKGSQSRMGGGGALQWNCSGGIQ

SEQ ID NO: 762457 - protein, 102 aa, Homo sapiens [sequence omitted]

SEQ ID NO: 762458 - protein, 459 aa, Homo sapiens
MALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGACN

SEQ ID NO: 762459 - protein, 175 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCGEGKGLLGGENRESGRRGLKGLFCPRRGSRVEGWNQGEGGC

SEQ ID NO: 762460 - protein, 203 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGYSKGSQSRMGGGGALQWNCSGGIH

SEQ ID NO: 762461 - protein, 211 aa, Homo sapiens
PDSDSDHRLNEMPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSVY

SEQ ID NO: 762462 - protein, 127 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 762463 - protein, 161 aa, Homo sapiens
MFLFSRKTRTPISTYSDSYRAPTSIKEVYKDPPLCAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKVSVAPSTDVWGLGHAYPTTSQTTVTDISP

SEQ ID NO: 762464 - protein, 112 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTKVRRAPPASAGLH

SEQ ID NO: 762465 - protein, 77 aa, Homo sapiens
RPNPSMLAASSFSRCVPPYEHRPGMQCAVTTPPPSYYPYPNLRWDTSHFKKSGGPQRNNYVIHPEFVSETYPDYRCW

SEQ ID NO: 762466 - protein, 127 aa, Homo sapiens; identical to SEQ ID NO: 762462

SEQ ID NO: 762467 - protein, 262 aa, Homo sapiens
MFLFSRKTRTPISTYSDSYRAPTSIKEVYKDPPLCAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKEARMETAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 762468 - protein, 111 aa, Homo sapiens
METAVRGMPLECPPRPERLNAYEREVMVNMLNSLSRNQQLPRITPRCGCVPPYEHRPGMQCAVTTPPPSYYPYPNLRWDTSHFKKSGGPQRNNYVIHPEFVSETYPDYRCW

SEQ ID NO: 762469 - protein, 109 aa, Homo sapiens
TRPAPRQDGGLNAAGSGGKLRSAFPQLLAASAPISAEDSGAPGTGRNYSAYLERRRDSDLPQSNPRAGAVAKGSGGAVGCGEPRANSRTAEQRELPTNRRRRRSRHLPE

SEQ ID NO: 762470 - protein, 281 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADVSRTHPLPAHIDHSGHCRTPLTPVSAPLSVLLFPLCPPLASMSPLKPVNSATGWCPVYCPGPITSSGGPALLVSVTETEREDPGQEGEGSQSYLPKEY

SEQ ID NO: 762471 - protein, 281 aa, Homo sapiens; identical to SEQ ID NO: 762470

SEQ ID NO: 762472 - protein, 291 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFADVSRTHPLPAHIDHSGHCRTPLTPVSAPLSVLLFPLCPPLASMSPLKPVNSATGWCPVYCPGPITSSGGPALLVSVTETEREDPGQEGEGSQSYLPKEY

SEQ ID NO: 762473 - protein, 557 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 762474 - protein, 281 aa, Homo sapiens; identical to SEQ ID NO: 762470

SEQ ID NO: 762475 - protein, 281 aa, Homo sapiens; identical to SEQ ID NO: 762470

SEQ ID NO: 762476 - protein, 112 aa, Homo sapiens
GWVNLKSVLQIKKAEMDRKTLDWEIVELTNKLLDAKNTINKLEELNVCALHYSGLPHLGLALSWLGPASLERAGLGSETGLCLEERYRLDCNLAVQLLKCNKSHFRNHKFAD

SEQ ID NO: 762477 - protein, 547 aa, Homo sapiens
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 762478 - protein, 240 aa, Homo sapiens
MKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADVSRTHPLPAHIDHSGHCRTPLTPVSAPLSVLLFPLCPPLASMSPLKPVNSATGWCPVYCPGPITSSGGPALLVSVTETEREDPGQEGEGSQSYLPKEY

SEQ ID NO: 762479 - protein, 374 aa, Homo sapiens [sequence omitted]

SEQ ID NO: 762480 - protein, 506 aa, Homo sapiens
MKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 762481 - protein, 281 aa, Homo sapiens; identical to SEQ ID NO: 762470

SEQ ID NO: 762482 - protein, 77 aa, Homo sapiens
AAAYYYYYCSEFKLLTMYGDMSCCPPGAWHSWPWGRGRGLIQGPLSCLLPPSGKEGGAQGPQAGLCVRPGPHSQPWL

SEQ ID NO: 762483 - protein, 445 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762484 - protein, 71 aa, Homo sapiens
KPFSSCNHGHLSYVLEVSKRLLGYCFLGANGLANPRDFLIPIAWYEDRQVPGGYTVINKYQGKLFAAKQVK

SEQ ID NO: 762485 - protein, 338 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHNLA

SEQ ID NO: 762486 - protein, 338 aa, Homo sapiens; identical to SEQ ID NO: 762485

SEQ ID NO: 762487 - protein, 304 aa, Homo sapiens
MENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762488 - protein, 425 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQVTWSCELTGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762489 - protein, 244 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIDSLGLPKRMSPRSMLWPGTGIIHPTSTT

SEQ ID NO: 762490 - protein, 274 aa, Homo sapiens
MLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762491 - protein, 213 aa, Homo sapiens
MSLRRPGATSWRSMVSTLSYLTLDQLDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762492 - protein, 109 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQVTWSCELKLIIYPKP

SEQ ID NO: 762493 - protein, 445 aa, Homo sapiens; identical to SEQ ID NO: 762483

SEQ ID NO: 762494 - protein, 338 aa, Homo sapiens; identical to SEQ ID NO: 762485

SEQ ID NO: 762495 - protein, 248 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGCLPVQCCGLARELYTLQVQPEEFHGYQLSGL

SEQ ID NO: 762496 - protein, 260 aa, Homo sapiens [sequence omitted]

SEQ ID NO: 762497 - protein, 163 aa, Homo sapiens
MVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 762498 - protein, 267 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQDVSPFNVVAWHGNYTPYKYNLKNFMVINSVAFDHAAFMFESSLSLAVTKWGLKASRCLDENYHKCWEPLKSHFTPNSRNPAEPN

SEQ ID NO: 762499 - protein, 678 aa, Homo sapiens
ILSSAPAAARLAAEAEGPRAPERKGFRGTTCPSRAKAGGAGRARLPGPERKPAATRGPVRTGTRPSRGPVSRAHVGCLLLDSAMGPFWARKDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762500 - protein, 709 aa, Homo sapiens
GGALEPHQEPPPAARAGSAQSPRSVLAGASSWTAAAAARGAGGQRRDGAPPREQEEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762501 - protein, 759 aa, Homo sapiens
TLGHRERQQLLLTQLIGLGDGALSALIEPKKTPCIHRHQQILTGSSGPDLAALWKVLFNQLDRAVCFPHLTLTAILEVPPPGRRQRRREEPAGSGAMGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762502 - protein, 533 aa, Homo sapiens
MFAMKVYGAYLLSSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762503 - protein, 641 aa, Homo sapiens
GGALEPHQEPPPAARAGSAQSPRSVLAGASSWTAAAAARGAGGQRRDGAPPREQDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762504 - protein, 773 aa, Homo sapiens
ILSSAPAAARLAAEAEGPRAPERKGFRGTTCPSRAKAGGAGRARLPGPERKPAATRGPVRTGTRPSRGPVSRAHVGCLLLDSAMGPFWARKGASSWTAAAAARGAGGQRRDGAPPREQEEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 762505 - protein, 709 aa, Homo sapiens; identical to SEQ ID NO: 762500

SEQ ID NO: 762506 - protein, 557 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKGVSMLQDSWSSVISYQKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 762507 - protein, 540 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 762508 - protein, 613 aa, Homo sapiens
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKGVSMLQDSWSSVISYQKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 762509 - protein, 528 aa, Homo sapiens
RDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLIGTLTRTSDSEVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 762510 - protein, 343 aa, Homo sapiens [sequence omitted]

SEQ ID NO: 762511 - protein, 198 aa, Homo sapiens
MLEAQLAKIKLEKENQRIADKLKNTGSAQLVGLAQENAAVSNTAGQDEATAKAVLEPIQSTSLIGTLTRTSDSEVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 762512 - protein, 517 aa, Homo sapiens
RDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 762513 - protein, 109 aa, Homo sapiens [sequence omitted]

SEQ ID NO: 762514 - protein, 524 aa, Homo sapiens
RDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLIGTLTRTSDSEVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKVCEVR

SEQ ID NO: 762515 - protein, 190 aa, Homo sapiens
RDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKGRP

SEQ ID NO: 762516 - protein, 349 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 762517 - protein, 36 aa, Homo sapiens
MPVERMRMRPWLEEQINSNTIPGLKWLNKTRSPSVT

SEQ ID NO: 762518 - protein, 349 aa, Homo sapiens; identical to SEQ ID NO: 762516

SEQ ID NO: 762519 - protein, 349 aa, Homo sapiens; identical to SEQ ID NO: 762516

SEQ ID NO: 762520 - protein, 166 aa, Homo sapiens
DRYRVIAVPEYPQYYICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 762521 - protein, 349 aa, Homo sapiens; identical to SEQ ID NO: 762516

SEQ ID NO: 762522 - protein, 117 aa, Homo sapiens
KFAAARPYNSSCSPFKDLPLSSSMTPASSSSRPDRETRLLEVTKDAMRHAVSFTDLQVTIKEESNPVPYNSSWPPFQDLPLSSSMTPASSSSRPDRETRASVIKKTSDITQARVKSC

SEQ ID NO: 762523 - protein, 290 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKVVGQSHLDSNIENQEIVTNPPDICQVVEVTTESDEQPVSMSELYPLQISPVSSYAESETTDSVPSDEESAEGRPHWRKSGNPWAQLREDFCLSSSALIGLLVIAVAIATVIVISLVMLRKRQYGTISHGIVEVDPMLTPEERHLYKMQNHGYENPYLHTWSYFAGDPLG

SEQ ID NO: 762524 - protein, 349 aa, Homo sapiens; identical to SEQ ID NO: 762516

SEQ ID NO: 762525 - protein, 349 aa, Homo sapiens; identical to SEQ ID NO: 762516

SEQ ID NO: 762526 - protein, 230 aa, Homo sapiens [sequence omitted]

SEQ ID NO: 762527 - protein, 349 aa, Homo sapiens; identical to SEQ ID NO: 762516

SEQ ID NO: 762528 - protein, 276 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPDLQVTIKEESNPVPYNSSWPPFQDLPLSSSMTPASSSSRPDRETRASVIKKTSDITQARVKSC

SEQ ID NO: 762529 - protein, 345 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKSGNPWAQLREDFCLSSSALIGLLVIAVAIATVIVISLVMLRKRQYGTISHGIVEVDPMLTPEERHLYKMQNHGYENPYLHTWSYFAGDPLG

SEQ ID NO: 762530 - protein, 699 aa, Homo sapiens
MRPLTCNSFTESLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPDVSEEAKEEQKGLSSPLAGEGRAGGNSEKPTVLKLTRKEGLQGPVETESVV

SEQ ID NO: 762531 - protein, 582 aa, Homo sapiens
MRPLTCNSFTESLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQVRPP

SEQ ID NO: 762532 - protein, 699 aa, Homo sapiens; identical to SEQ ID NO: 762530

SEQ ID NO: 762533 - protein, 209 aa, Homo sapiens
MGRRGLVIYAGTGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPDVSEEAKEEQKGLSSPLAGEGRAGGNSEKPTVLKLTRKEGLQGPVETESVV

SEQ ID NO: 762534 - protein, 757 aa, Homo sapiens
QLSRPGPAQALRPRRRGDGHLPPSGEAGGLQSPDPGKSHHWSAGRPVRTRRPLKGPGGSGGDLGGRRGGESGAARWGIEMGFHHVGQIGLGFLTSSDPKCWDYRHEPLCLANSVDFSSENCILDSDTATKTNCCCPDEYTVARLTQADRKQSEGYQKGADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 762535 - protein, 659 aa, Homo sapiens
TSFPVPGQRRRSGLGGGAMATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRACLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 762536 - protein, 506 aa, Homo sapiens [sequence omitted]

SEQ ID NO: 762537 - protein, 126 aa, Homo sapiens [sequence omitted]

SEQ ID NO: 762538 - protein, 551 aa, Homo sapiens
MAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 762539 - protein, 277 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 762540 - protein, 324 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 762541 - protein, 277 aa, Homo sapiens; identical to SEQ ID NO: 762539

SEQ ID NO: 762542 - protein, 277 aa, Homo sapiens; identical to SEQ ID NO: 762539

SEQ ID NO: 762543 - protein, 183 aa, Homo sapiens
WVDRGLWVDRGLWVDRGLWTELTNDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 762544 - protein, 105 aa, Homo sapiens
PQRSLSLPHAGIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 762545 - protein, 71 aa, Homo sapiens
YGLSSIQALGRLSRREQQPSVTSRSGGTQVQQTPASCPLDSDLSEDEDLQLAMAYSLSEMEAAGKKPADVF

SEQ ID NO: 762546 - protein, 111 aa, Homo sapiens
WYGPEVRLDTVPGGGQGRGAAGGRDSWRRRCGRGPGSGWGPWIGLLELGGPDRAPGPGRRDSSWPRPAGADKAAGGSLVTGRKQSPLCSASNWERLPPPGEGDCCSHRVGL

SEQ ID NO: 762547 - protein, 324 aa, Homo sapiens; identical to SEQ ID NO: 762540

SEQ ID NO: 762548 - protein, 78 aa, Homo sapiens
EPAFSPSLVVSAPLTHACAHSWAGRVLRSSREPGCGCQTVPGGGQGRGAAGGRDSWRRSPKEARLTTDQLPWHPTTRS

SEQ ID NO: 762549 - protein, 153 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDEKTEAQLIAQSHITHGRAGLLAVSACHRVMMICLY

SEQ ID NO: 762550 - protein, 54 aa, Homo sapiens
DLGPFSELQNRGSRHSGPFFTFSSSFPGHSGKFCPFPRLQAPIPGTPGLSLLLF

SEQ ID NO: 762551 - protein, 324 aa, Homo sapiens; identical to SEQ ID NO: 762540

SEQ ID NO: 762552 - protein, 324 aa, Homo sapiens; identical to SEQ ID NO: 762540

SEQ ID NO: 762553 - protein, 324 aa, Homo sapiens; identical to SEQ ID NO: 762540

SEQ ID NO: 762554 - protein, 256 aa, Homo sapiens
MYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 762555 - protein, 259 aa, Homo sapiens
MASYYEILDVPRSASADDIKKAYRRKALQWHPDKNPDNKEFAEKKFKEVAEAYEVLSDRTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 762556 - protein, 385 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRSESSFWGHRGVRGLLGSCVQIESWLLEGRAQSALSTAGGQNWDQRLQDSVTARCLNCAVSHRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 762557 - protein, 179 aa, Homo sapiens
KDLRCSSHLAYRTIAWVDMNPRHTGCAGLEETCEGAWSGKQFYNSGYSLFSSTVSHDPPVNGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 762558 - protein, 277 aa, Homo sapiens; identical to SEQ ID NO: 762539

SEQ ID NO: 762559 - protein, 147 aa, Homo sapiens
MYPGTVYQKYEPIFFQSIGNPFIFRCLDGVLIDGNDKGISKVVYRSCNGRDRLGPLKMSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 762560 - protein, 50 aa, Homo sapiens
MVGFGLGTLRYVPEESKDKVISDEDVLGTLLKVFQALFLNDFNKQSEILK

SEQ ID NO: 762561 - protein, 146 aa, Homo sapiens
VEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFM

SEQ ID NO: 762562 - protein, 222 aa, Homo sapiens
MESPGESGAGSPGAPSPSSFTTGHLAREKPAQDPLYDVPNASGGQAGGPQRPGRVVSLRERLLLTRPVWLQLQANAAAALHMLRTEPPGTFLVRKSNTRQCQALCMRLPEASGPSFVSSHYILESPGGVSLEGSELMFPDLVQLICAYCHTRDILLLPLQLPRAIHHAATHKELEAISHLGIGKGFLPPIAQMNKLRPRGRQGSQHTARSPCLALVGKLPLT

SEQ ID NO: 762563 - protein, 783 aa, Homo sapiens
MESPGESGAGSPGAPSPSSFTTGHLAREKPAQDPLYDVPNASGGQAGGPQRPGRVVSLRERLLLTRPVWLQLQANAAAALHMLRTEPPGTFLVRKSNTRQCQALCMRLPEASGPSFVSSHYILESPGGVSLEGSELMFPDLVQLICAYCHTRDILLLPLQLPRAIHHAATHKELEAISHLGIEFWSSSLNIKAQRGPAGGPVLPQLKARSPQELDQGTGAALCFFNPLFPGDLGPTKREKFKRSFKVRVSTETSSPLSPPAVPPPPVPVLPGAVPSQTERLPPCQLLRRESSVGYRVPAGSGPSLPPMPSLQEVDCGSPSSSEEEGVPGSRGSPATSPHLGRRRPLLRSMSAAFCSLLAPERQVGRAAAALMQDRHTAAGQLVQDLLTQVRAGPEPQELQGIRQALSRARAMLSAELGPEKLLSPKRLEHVLEKSLHCSVLKPLRPILAARLRRRLAADGSLGRLAEGLRLARAQGPGAFGSHLSLPSPVELEQVRQKLLQLLRTYSPSAQVKRLLQACKLLYMALRTQEGEGAGADEFLPLLSLVLAHCDLPELLLEAEYMSELLEPSLLTGEGGYYLTSLSASLALLSGLGQAHTLPLSPVQELRRSLSLWEQRRLPATHCFQHLLRVAYQDPSSGCTSKTLAVPPEASIATLNQLCATKFRVTQPNTFGLFLYKEQGYHRLPPGALAHRLPTTGYLVYRRAEWPETQGAVTEEEGSGQSEARSRGEEQGCQGDGDAGVKASPRDIREQSETTAEGGQGQAQEGPAQPGEPEAEGSRAAEE

SEQ ID NO: 762564 - protein, 685 aa, Homo sapiens [sequence omitted]

SEQ ID NO: 762565 - protein, 386 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNCSLGGVGMMCSLSEQGKQLAIQVSNILGMDVCGIDLLMKDDGSFCVCEANANVGFIAFDKACNLDVAGIIADYAASLLPSGRLTRRMSLLSVVSTASETSEPELGPPASTAVDNMSASSSSVDSDPESTERELLTKLPGGLFNMNQLLANEIKLLVD

SEQ ID NO: 762566 - protein, 307 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNCSLGGVGMMCSLSEQGKQLAIQVSNILGMDVCGIDLLMKDDGSFCVCEANANPFQEPKKQIQTNKKIPREKTFLLPPS

SEQ ID NO: 762567 - protein, 386 aa, Homo sapiens; identical to SEQ ID NO: 762565

SEQ ID NO: 762568 - protein, 386 aa, Homo sapiens; identical to SEQ ID NO: 762565

SEQ ID NO: 762569 - protein, 386 aa, Homo sapiens; identical to SEQ ID NO: 762565

SEQ ID NO: 762570 - protein, 386 aa, Homo sapiens; identical to SEQ ID NO: 762565

SEQ ID NO: 762571 - protein, 386 aa, Homo sapiens; identical to SEQ ID NO: 762565

SEQ ID NO: 762572 - protein, 386 aa, Homo sapiens; identical to SEQ ID NO: 762565

SEQ ID NO: 762573 - protein, 386 aa, Homo sapiens; identical to SEQ ID NO: 762565

SEQ ID NO: 762574 - protein, 386 aa, Homo sapiens; identical to SEQ ID NO: 762565

SEQ ID NO: 762575 - protein, 386 aa, Homo sapiens; identical to SEQ ID NO: 762565

SEQ ID NO: 762576 - protein, 636 aa, Homo sapiens
MFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 762577 - protein, 591 aa, Homo sapiens
MFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPPTITK

SEQ ID NO: 762578 - protein, 600 aa, Homo sapiens
MFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPEKMLAGGASKDIYA

SEQ ID NO: 762579 - protein, 366 aa, Homo sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 762580 - protein, 366 aa, Homo sapiens; identical to SEQ ID NO: 762579

SEQ ID NO: 762581 - protein, 366 aa, Homo sapiens; identical to SEQ ID NO: 762579

SEQ ID NO: 762582 - protein, 749 aa, Homo sapiens
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVTEMVLEMSLEVCSCPDLRFSMALCDQEKTFRQQRKEHIRESMKKLLGPKNSEGLHSARDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYKAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 762583 - protein, 749 aa, Homo sapiens; identical to SEQ ID NO: 762582

SEQ ID NO: 762584 - protein, 262 aa, Homo sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 762585 - protein, 198 aa, Homo sapiens
ETARPAPPCSPWRLHSSTGHTSAVCTQMASSMTWTAASIPATLIQRGLLTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 762586 - protein, 287 aa, Homo sapiens
KQPARHHHARPGGCTIQVAGGSLSMPLCLSPSRLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 762587 - protein, 167 aa, Homo sapiens
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 762588 - protein, 144 aa, Homo sapiens
MDKLKQNKFNDISKARKKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 762589 - protein, 237 aa, Homo sapiens
MLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 762590 - protein, 237 aa, Homo sapiens; identical to SEQ ID NO: 762589

SEQ ID NO: 762591 - protein, 197 aa, Homo sapiens
MLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIDLRGKI

SEQ ID NO: 762592 - protein, 237 aa, Homo sapiens; identical to SEQ ID NO: 762589

SEQ ID NO: 762593 - protein, 237 aa, Homo sapiens; identical to SEQ ID NO: 762589

SEQ ID NO: 762594 - protein, 101 aa, Homo sapiens
LSMIQNIHRCFRDPHHLPKEKALLLPGNSQKKRKRQPLRADFLKTELFWAWCTPPGWVTRHSLGQAGPSGTTVSWPPNLCALRQITEPCLQDANNSEDLYS

SEQ ID NO: 762595 - protein, 184 aa, Homo sapiens
EEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 762596 - protein, 184 aa, Homo sapiens; identical to SEQ ID NO: 762595

SEQ ID NO: 762597 - protein, 202 aa, Homo sapiens
EEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPPQLGRWGCTCQRRREMTPPPSLV

SEQ ID NO: 762598 - protein, 170 aa, Homo sapiens
MTSCMTTAADGFERSEVSMVFRDSEDGLSGGAGPSRSLCCLFAPVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 762599 - protein, 117 aa, Homo sapiens
PRVADAWVDPRVGARPEPAVLQAPSILLDAPRTDGGDMGRAMVARLGLGLLLLALLLPTQIYSSETTTGTSSNSSQSTSNSGLAPNPTNATTKAAGGALQSTASLFVVSLSLLHLYS

SEQ ID NO: 762600 - protein, 104 aa, Homo sapiens
RSLALSPRLECSGPVWGHCNLRLLGSSDSLAQASREAGTTGVSTHAQIYSSETTTGTSSNSSQSTSNSGLAPNPTNATTKAAGGALQSTASLFVVSLSLLHLYS

SEQ ID NO: 762601 - protein, 194 aa, Homo sapiens
PRTPPPIRCRAICGTICPTPTPHTHQAGSSTRVHLGGSGLTAPRTTCHSYARKTPSPNDAPHILLRLSFHAISWAQTAIALLLLLPPNASYRLRSCRLGLQSIPPASAELLNRPSSTVLEGGLLASAVRSSWGIYGFIFSVTTICAPSSNSSQSTSNSGLAPNPTNATTKAAGGALQSTASLFVVSLSLLHLYS

SEQ ID NO: 762602 - protein, 94 aa, Homo sapiens
VGACMLALPYHPISFHSVSCDTNTLRFVSLLIYPLYLSHRPMYVDRATLVCRSLKRPPRWVMHLAGRSSAYSFVGDQDEASRAPVELLVRCARY

SEQ ID NO: 762603 - protein, 227 aa, Homo sapiens
SLQRQAAGLRPASGSPAPGKMRTRDAPVSSLRLADTRRSQNKARAGGWRGRGAERADRSGPGHRLRGAPTSREGFALGGARVPSARVSVRPASAPRPPRSPFLCGGPRDNPARGVPAPAPHAVALEFAAPLGSPGRILQSEWQCTCSRTGGYPAAAEARTFLLGGLAGSPRSPPCLRPPGASGSPSTQHPARRAAHRRRGHGQSNGGQARAGAAAAGTAPTHADLFQ

SEQ ID NO: 762604 - protein, 117 aa, Homo sapiens; identical to SEQ ID NO: 762599

SEQ ID NO: 762605 - protein, 227 aa, Homo sapiens; identical to SEQ ID NO: 762603

SEQ ID NO: 762606 - protein, 227 aa, Homo sapiens; identical to SEQ ID NO: 762603

SEQ ID NO: 762607 - protein, 92 aa, Homo sapiens
NAQDLLERGTSSDGRAMVARLGLGLLLLALLLPTQIYSSETTTGTSSNSSQSTSNSGLAPNPTNATTKAAGGALQSTASLFVVSLSLLHLYS

SEQ ID NO: 762608 - protein, 92 aa, Homo sapiens
PPEALNGHHGGDMGRAMVARLGLGLLLLALLLPTQIYSSETTTGTSSNSSQSTSNSGLAPNPTNATTKAAGGALQSTASLFVVSLSLLHLYS

SEQ ID NO: 762609 - protein, 82 aa, Homo sapiens
CHCPKSRVLLLLPRLLLLALLLPTQIYSSETTTGTSSNSSQSTSNSGLAPNPTNATTKAAGGALQSTASLFVVSLSLLHLYS

SEQ ID NO: 762610 - protein, 227 aa, Homo sapiens; identical to SEQ ID NO: 762603

SEQ ID NO: 762611 - protein, 230 aa, Homo sapiens
SLQRQAAGLRPASGSPAPGKMRTRDAPVSSLRLADTRRSQNKARAGGWRGRGAERADRSGPGHRLRGAPTSREGFALGGARVPSARVSVRPASAPRPPRSPFLCGGPRDNPARGVPAPAPHAVALEFAAPLGSPGRILQSEWQCTCSRTGGYPAAAEARTFLLGFIPVKQQLELQVTPPRVLPTLGWPQIQLMPPPRRLVVPCSQQPVSSWSHSLFCISTLKRLRPRNVF

SEQ ID NO: 762612 - protein, 77 aa, Homo sapiens
DEVKVRGRVYISDEVRLPTLIYSSETTTGTSSNSSQSTSNSGLAPNPTNATTKAAGGALQSTASLFVVSLSLLHLYS

SEQ ID NO: 762613 - protein, 104 aa, Homo sapiens; identical to SEQ ID NO: 762600

SEQ ID NO: 762614 - protein, 227 aa, Homo sapiens; identical to SEQ ID NO: 762603

SEQ ID NO: 762615 - protein, 227 aa, Homo sapiens; identical to SEQ ID NO: 762603

SEQ ID NO: 762616 - protein, 227 aa, Homo sapiens; identical to SEQ ID NO: 762603

SEQ ID NO: 762617 - protein, 227 aa, Homo sapiens; identical to SEQ ID NO: 762603

SEQ ID NO: 762618 - protein, 227 aa, Homo sapiens; identical to SEQ ID NO: 762603

SEQ ID NO: 762619 - protein, 267 aa, Homo sapiens
VFSFATTHAGMKESEAAGLNSIFWGTFAACRGLAIFFATCLQPGTMIVLSNIGSLTSSLFLVLFDKNPICLWIATSVYGASMATTFPSGVSWIEQYTTIHGKSAAFFVIGASLGEMAIPAVIGILQGKYPDLPVVLYTSLGASIATGILFPVLYKLATSPLDRQRKEDRKSEDQKALLSSSGLNEYEEENEEEDAEKWNEMDFEMIETNDTMRHSIIETSRSSLTEPTAEVYNQYPSNALVFESSPFNTGSAHVKHLPETRTKGTNV

SEQ ID NO: 762620 - protein, 187 aa, Homo sapiens
FTPRFSSMCVLGSPPAVPAGVTVPQGQTAVCTAIASSSDSAVRHRDISSPGGPTPLLCPVHQATLPPVFTPGFKQGSTSYTLLKRVSPPPRGPLSLKGKNSRCHAGPQRSRKATPVSEPFQAVHEQKGSQIYSSETTTGTSSNSSQSTSNSGLAPNPTNATTKAAGGALQSTASLFVVSLSLLHLYS

SEQ ID NO: 762621 - protein, 75 aa, Homo sapiens
GSGTEAGVESAEVSYPRQIYSSETTTGTSSNSSQSTSNSGLAPNPTNATTKAAGGALQSTASLFVVSLSLLHLYS

SEQ ID NO: 762622 - protein, 185 aa, Homo sapiens
MTCRAESFIDTYRNRRNLYQVTSNEDNASIHKREEAVLHSSRILRDSLRRPRGTVLSMIYCGKAQRFNTMYIRGIRTRLSFSTRGQFRHKWASQAQMSNITRCTARHKSRARVPGVGHFNCPRERESRLIQGITRLALSSNSSQSTSNSGLAPNPTNATTKAAGGALQSTASLFVVSLSLLHLYS

SEQ ID NO: 762623 - protein, 202 aa, Homo sapiens
SLQRQAAGLRPASGSPAPGKMRTRDAPVSSLRLADTRRSQNKARAGGWRGRGAERADRSGPGHRLRGAPTSREGFALGGARVPSARVSPARRAPHLACARPEPAVLQAPSILLDAPRTDGGDMGRAMVARLGLGLLLLALLLPTQIYSSETTTGTSSNSSQSTSNSGLAPNPTNATTKAAGGALQSTASLFVVSLSLLHLYS

SEQ ID NO: 762624 - protein, 111 aa, Homo sapiens
RPRVRLRARPEPAVLQAPSILLDAPRTDGGDMGRAMVARLGLGLLLLALLLPTQIYSSETTTGTSSNSSQSTSNSGLAPNPTNATTKAAGGALQSTASLFVVSLSLLHLYS

SEQ ID NO: 762625 - protein, 227 aa, Homo sapiens; identical to SEQ ID NO: 762603

SEQ ID NO: 762626 - protein, 227 aa, Homo sapiens; identical to SEQ ID NO: 762603

SEQ ID NO: 762627 - protein, 227 aa, Homo sapiens; identical to SEQ ID NO: 762603

SEQ ID NO: 762628 - protein, 227 aa, Homo sapiens; identical to SEQ ID NO: 762603

SEQ ID NO: 762629 - protein, 227 aa, Homo sapiens; identical to SEQ ID NO: 762603

SEQ ID NO: 762630 - protein, 82 aa, Homo sapiens
IIRVNDYRDEYRSGLLLLALLLPTQIYSSETTTGTSSNSSQSTSNSGLAPNPTNATTKAAGGALQSTASLFVVSLSLLHLYS

SEQ ID NO: 762631 - protein, 75 aa, Homo sapiens; identical to SEQ ID NO: 762621

SEQ ID NO: 762632 - protein, 129 aa, Homo sapiens
MVGRFCPESPPGFVRVAATSAVSLDPPSGEPRPGCGYPGPRSAASRVYGCTAPARETGGWAWETLAGAGAKKIYSSETTTGTSSNSSQSTSNSGLAPNPTNATTKAAGGALQSTASLFVVSLSLLHLYS

SEQ ID NO: 762633 - protein, 187 aa, Homo sapiens; identical to SEQ ID NO: 762620

SEQ ID NO: 762634 - protein, 227 aa, Homo sapiens; identical to SEQ ID NO: 762603

SEQ ID NO: 762635 - protein, 227 aa, Homo sapiens; identical to SEQ ID NO: 762603

SEQ ID NO: 762636 - protein, 227 aa, Homo sapiens; identical to SEQ ID NO: 762603

SEQ ID NO: 762637 - protein, 227 aa, Homo sapiens; identical to SEQ ID NO: 762603

SEQ ID NO: 762638 - protein, 227 aa, Homo sapiens; identical to SEQ ID NO: 762603

SEQ ID NO: 762639 - protein, 227 aa, Homo sapiens; identical to SEQ ID NO: 762603

SEQ ID NO: 762640 - protein, 155 aa, Homo sapiens
FPPLLCFAGPLAPLALPPAPLSRRPPSSWAVPPGRSFAFSLLPFSFPPPSASPFPFLFSVPSPPPPPPPPPPPPPPPPPPPPLPPPPPAPPPPPPPAALPPLPPSPSPPPPPPPPPPPPPPAPLFCFIPECCTSILDCILCLCIYALIHSNFLWN

SEQ ID NO: 762641 - protein, 130 aa, Homo sapiens
MSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 762642 - protein, 225 aa, Homo sapiens
MEEEEMNDGSQMVRSQESLTFQDVAVDFTREEWDQLYPAQKNLYRDVMLENYRNLVALGYQLCKPEVIAQLELEEEWVIERDSLLDTHPGDQSHVMSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 762643 - protein, 130 aa, Homo sapiens; identical to SEQ ID NO: 762641

SEQ ID NO: 762644 - protein, 87 aa, Homo sapiens
RRSVLRRHCGEAVLRAGLARRWLDRPQEPSHRASLAQAAGPSAPSPSRVHRGGGGGGGGGGGGVRGRSLPKRPLSAEVNIPGLRRQD

SEQ ID NO: 762645 - protein, 75 aa, Homo sapiens
SISRSSRPLKLLPKRTSSSNTRTGQALDHLFPDGEWLRKQPTTTSASQVQVILLQPPEVARITGMCHHAQLILYF

SEQ ID NO: 762646 - protein, 130 aa, Homo sapiens; identical to SEQ ID NO: 762641

SEQ ID NO: 762647 - protein, 238 aa, Homo sapiens
MPSQNAVFSQEGNMEEEEMNDGSQMVRSQESLTFQDVAVDFTREEWDQLYPAQKNLYRDVMLENYRNLVALGYQLCKPEVIAQLELEEEWVIERDSLLDTHPGDQSHVMSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 762648 - protein, 130 aa, Homo sapiens; identical to SEQ ID NO: 762641

SEQ ID NO: 762649 - protein, 97 aa, Homo sapiens
LGLWRPLGAAAPGTLALYPQPHPRNRVPGGEQAEGRSGPGITCPAMTCAPPPGLLELSPVERGVVSIFGVASRFFVAMSSKGKLYGSVSTAGVWLGT

SEQ ID NO: 762650 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 762651 - protein, 605 aa, Homo sapiens
GPLERKPESCRAPAGRGRRSQASEPGLRWGPPPGPRVPRPLLPAHPSPRDPLARGGAGPRRLREGASPPRMGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 762652 - protein, 153 aa, Homo sapiens [sequence omitted]

SEQ ID NO: 762653 - protein, 153 aa, Homo sapiens [sequence omitted]

SEQ ID NO: 762654 - protein, 153 aa, Homo sapiens [sequence omitted]

SEQ ID NO: 762655 - protein, 515 aa, Homo sapiens
LSLGRAARGRQSPLDKEPLTALICLLSQQTGWKGGRKCPPKPPCQTSWQVSLWEPGSLLVSPLNTVVLRTQNSQMSRRSQFVQGSPGCGWTMAATPMAWVGPASASSAPPGDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 762656 - protein, 575 aa, Homo sapiens
PGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 762657 - protein, 575 aa, Homo sapiens; identical to SEQ ID NO: 762656

SEQ ID NO: 762658 - protein, 38 aa, Homo sapiens
YAGNGGLLGADFAGDLDYNELAVRVSESMQRKWGHLGL

SEQ ID NO: 762659 - protein, 575 aa, Homo sapiens; identical to SEQ ID NO: 762656

SEQ ID NO: 762660 - protein, 186 aa, Homo sapiens
PGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRSKPFPMPCTWHLPPVGLLLLPEPHLLVCCLLCPSLEHEF

SEQ ID NO: 762661 - protein, 198 aa, Homo sapiens
MSSKRSHYDSALKRKVIVYAEKHGNRAAGRTFDISEANIRRWRNDRNSIFSCKATTKCFTGPKKGRYPQVDEAVLRFVSETRAKGLPITRQAMQLKAGEVAKTLGIDETKFKATRGWCDRFMRRAGLSLRHQTSFCPKLPTAIKQKTVLEHSFKKCCITSTLDNTGRDVLWKNADINDCGLKSDSEELDSEYEVIIIT

SEQ ID NO: 762662 - protein, 103 aa, Homo sapiens
MPPRADCPSAPKMWHSVGLTLLVFVATLLIVLLLMVCGWYFVWHLFLSKFKFLRELVGDTGSQEGDHEPSGSETEEDTSSSPHRIRSARQRRAPADEGHRPLT

SEQ ID NO: 762663 - protein, 229 aa, Homo sapiens
MLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYDSAGMCYPSAKNHEQTFSYFIVDPIRRHLHVLYHCYGVGDMS

SEQ ID NO: 762664 - protein, 113 aa, Homo sapiens
LHGNGPGIHPAESTMATGELGDLGGYYFRFLPQKTFQSLSSKEITSRLRQWSMLGRIKAQAFGFDQTFQSYRKDDFVMAFFKDPNVIPNLKLLSDSSGQWIILGFASGRLRKI

SEQ ID NO: 762665 - protein, 217 aa, Homo sapiens
LHGNGPGIHPAESTMATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVR

SEQ ID NO: 762666 - protein, 281 aa, Homo sapiens
LHGNGPGIHPAESTMATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYDSAGMCYPSAKNHEQTFSYFIVDPIRRHLHVLYHCYGVGDMS

SEQ ID NO: 762667 - protein, 255 aa, Homo sapiens
LHGNGPGIHPAESTMATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYVSVRELLQPKNLITFY

SEQ ID NO: 762668 - protein, 542 aa, Homo sapiens
RRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 762669 - protein, 542 aa, Homo sapiens; identical to SEQ ID NO: 762668

SEQ ID NO: 762670 - protein, 310 aa, Homo sapiens
RRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDKQEEICEGKIQNLNARVVMNCSRPSSAFRKHTGNGRVAFFLPHGVRVCVFLGKKSAWDARGLAVRSAHDGNFSGLGYNEGEMKICRRGVYLHAT

SEQ ID NO: 762671 - protein, 115 aa, Homo sapiens
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 762672 - protein, 115 aa, Homo sapiens; identical to SEQ ID NO: 762671

SEQ ID NO: 762673 - protein, 115 aa, Homo sapiens; identical to SEQ ID NO: 762671

SEQ ID NO: 762674 - protein, 115 aa, Homo sapiens; identical to SEQ ID NO: 762671

SEQ ID NO: 762675 - protein, 115 aa, Homo sapiens; identical to SEQ ID NO: 762671

SEQ ID NO: 762676 - protein, 115 aa, Homo sapiens; identical to SEQ ID NO: 762671

SEQ ID NO: 762677 - protein, 174 aa, Homo sapiens
MCKKALFAGEQEFNQKGQIPCHHLTLQTPPSSHLSSPLLQQGQNQQQGLRAWGSRDGYSPTSRYTGKLANTLGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 762678 - protein, 115 aa, Homo sapiens; identical to SEQ ID NO: 762671

SEQ ID NO: 762679 - protein, 162 aa, Homo sapiens
MRGGRRGIFGTEAYGPSHALASPGGPGMGRQEAAGVTPPRVLSARLRMRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 762680 - protein, 115 aa, Homo sapiens; identical to SEQ ID NO: 762671

SEQ ID NO: 762681 - protein, 115 aa, Homo sapiens; identical to SEQ ID NO: 762671

SEQ ID NO: 762682 - protein, 115 aa, Homo sapiens; identical to SEQ ID NO: 762671

SEQ ID NO: 762683 - protein, 177 aa, Homo sapiens
PPSSPFPPVPGSPFAPSLRPPAWMDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 762684 - protein, 177 aa, Homo sapiens; identical to SEQ ID NO: 762683

SEQ ID NO: 762685 - protein, 177 aa, Homo sapiens; identical to SEQ ID NO: 762683

SEQ ID NO: 762686 - protein, 441 aa, Homo sapiens
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 762687 - protein, 282 aa, Homo sapiens
MNSSTSTMSEEPDALSVVNQLRDLAADPLNRRAIVQDQGCLPGLILFMDHPNPPVVHSALLALRYLAECRANREKMKGELGMMLSLQNVIQKTTTPGETKLLASEIYDILQSSNMADGDSFNEMNSRRRKAQFFLGTTNKRAKTVVLHIDGLDDTSRRNLCEEALLKIKGVISFTFQMAVQRCVVRIRSDLKAEALASAIASTKVMKAQQVVKSESGEEMLVPFQDTPVEVEQNTELPDYLPEDESPTKEQDKAVSRVGSHPEGGASWLSTAANFLSRSFYW

SEQ ID NO: 762688 - protein, 105 aa, Homo sapiens
MLYRSKYNRQCLIYLYTYLYYHCSLNLPSSSYSPTSSSQVAGTTDMCHYTWLIFKLFCRDMVSLCCLGCCPGIKQSFCLSLPKCWNYRHEPSHPAQIVVFFFKWN

SEQ ID NO: 762689 - protein, 282 aa, Homo sapiens; identical to SEQ ID NO: 762687

SEQ ID NO: 762690 - protein, 240 aa, Homo sapiens
MNKQRGTFSEVSLAQDPKPQQRKPKGNKSSISGTEQEIFQVELNLQNASLNHQGIDKIYDCQGLLPPPEKLTAEVLGIICIVLMATVLKTIVLIPFLEQNNSSPNTRTQKARPCGHCPEEWITYSNSCYYIGKERRTWEESLQACASKNSSSLLSIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 762691 - protein, 226 aa, Homo sapiens
MNKQRGTFSEVSLAQDPKPQQRKPKGNKSSISGTEQEIFQVELNLQNASLNHQGIDKIYDCQGLLPPPEKLTAEVLGIICIVLMATVLKTIVLIPFLEQNNSSPNTRTQKARPCGHCPEEWITYSNSCYYIGKERRTWEESLQACASKNSSSLLSIDNEEEMKFLASILPSSWIGVFRNSSHHPWVTINGLAFKHEIKDSDHAERNCAMLHVRGLISDQCGSSRII

SEQ ID NO: 762692 - protein, 257 aa, Homo sapiens
MNKQRGTFSEVSLAQDPKPQQRKPKGNKSSISGTEQEIFQVELNLQNASLNHQGIDKIYDCQGLLPPPEKLTAEVLGIICIVLMATVLKTIVLIPFLEQNNSSPNTRTQKARPCGHCPEEWITYSNSCYYIGKERRTWEESLQACASKNSSSLLSIDNEEEMKFLASILPSSWIGVFRNSSHHPWVTINGLAFKHEIKDSDHAERNCAMLHVRGLISDQCGSSRIIVSISFRIKALELAVHQIKFYICSNRNDIMIA

SEQ ID NO: 762693 - protein, 69 aa, Homo sapiens
KHAEVTGTPDLRTCPGGGGDIHCNRQWDSKVGLLRNQREASTAGNGAGEWTERFHPFFQGGAAQEPVRG

SEQ ID NO: 762694 - protein, 616 aa, Homo sapiens
MLYIFNTSLFEPPPPGYENVSDIVPSFSAFSPQGMPEGDLVHVNYARTEDFFKLERDMKINCSGKIVIARYRKVFRGNKVKNAQLAGAKGVILYSDPADYFAPGVKSYPDGWNLPGGGVQRGNILNLNGAGDPLTPGYPANEYAYRHGIAEAVGLPSIPVHPVGYYDAQKLLEKMGGSAPPDSSWRGSLKVSYNVGPGFTGNFSTQKVKMHIHSTNEVTRIYNVIGTLRGAVEPDRYVILGGHRDSWVFGGIDPQSGAAVVHETVRSFGTLKKEGWRPRRTILFASWDAEEFGLLGSTEWAEDNSRLLQERGVAYINADSSIEGNYTLRVDCTPLMYSLVYNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYNISMKHPQEMKTYSLSFDSLFSAVKNFTEIASKFSERLQDFDKSNPILLRMMNDQLMFLERAFIDPLGLPDRPFYRHVIYAPSSHNKYAGESFPGIYDALFDIESKVDPSKAWGDVKRQISVAAFTVQAAAETLSEVA

SEQ ID NO: 762695 - protein, 538 aa, Homo sapiens
MVKNAQLAGAKGVILYSDPADYFAPGVKSYPDGWNLPGGGVQRGNILNLNGAGDPLTPGYPANEYAYRHGIAEAVGLPSIPVHPVGYYDAQKLLEKMGGSAPPDSSWRGSLKVSYNVGPGFTGNFSTQKVKMHIHSTNEVTRIYNVIGTLRGAVEPDRYVILGGHRDSWVFGGIDPQSGAAVVHETVRSFGTLKKEGWRPRRTILFASWDAEEFGLLGSTEWAEDNSRLLQERGVAYINADSSIEGNYTLRVDCTPLMYSLVYNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYNISMKHPQEMKTYSLSFDSLFSAVKNFTEIASKFSERLQDFDKSNPILLRMMNDQLMFLERAFIDPLGLPDRPFYRHVIYAPSSHNKYAGESFPGIYDALFDIESKVDPSKAWGDVKRQISVAAFTVQAAAETLSEVA

SEQ ID NO: 762696 - protein, 376 aa, Homo sapiens
SGAAGGRALPNDLPRGRWAGDGGVWMEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 762697 - protein, 145 aa, Homo sapiens
SGAAGGRALPNDLPRGRWAGDGGVWMEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSERTGRGLMS

SEQ ID NO: 762698 - protein, 312 aa, Homo sapiens
MFLVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 762699 - protein, 397 aa, Homo sapiens
SGAAGGRALPNDLPRGRWAGDGGVWMEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCKNFFFFWKKGGGAPPPKGGPPFSSLVYGAKTCL

SEQ ID NO: 762700 - protein, 105 aa, Homo sapiens
MDQEEGLKALDNIVTQFNAYEDFLDSQITTVDLYYLEDETLARQLVELGYRGTGERVKREDFEARKAAIEIARLAERAQQKSDSQLIFPRSGQRKASKKTCFHQC

SEQ ID NO: 762701 - protein, 135 aa, Homo sapiens
CPPASVARDASAEDTAMDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSVSTFHPTA

SEQ ID NO: 762702 - protein, 171 aa, Homo sapiens
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDIRRSQVTTLLESLS

SEQ ID NO: 762703 - protein, 249 aa, Homo sapiens
CPPASVARDASAEDTAMDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYIQAVIFDHISRRKT

SEQ ID NO: 762704 - protein, 134 aa, Homo sapiens
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSILEPILNHAMDRKSVTSPPKFIR

SEQ ID NO: 762705 - protein, 270 aa, Homo sapiens
NPKAFSTAGLSGLGESHVAAAPPDICSRTVWPDETMGPFGPQDQRFQLPGNIGFDCHLNGTASQKKSLVHKTLPDVLAEPLSSERHEFVMAQYVNEFQGNDAPVEQEINSAETYFESARVECAIQTCPELLRKDFESLFPEVANGKLMILTVTQKTKNDMTVWSEEVEIEREVLLEKFINGAKEICYALRAEGYWADFIDPSSGLAFFGPYTNNTLFETDERYRHLGFSVDDLGCCKVIRHSLWGTHVVVGSIFTNATPDSHIMKKLSGN

SEQ ID NO: 762706 - protein, 270 aa, Homo sapiens; identical to SEQ ID NO: 762705

SEQ ID NO: 762707 - protein, 112 aa, Homo sapiens
MFPKADIAWNVPVSLITWPLFRLFRGWRTPTTRVRWCHRSIPTVRSLGHGFWGLALAPNKGPRVLWPGLQTDLKGQGMLRPRGASRGPGLWLLSSDFYFLKTVKCLSFLFFK

SEQ ID NO: 762708 - protein, 402 aa, Homo sapiens [sequence omitted]

SEQ ID NO: 762709 - protein, 284 aa, Homo sapiens [sequence omitted]

SEQ ID NO: 762710 - protein, 296 aa, Homo sapiens
MVTGGWGGPGGDTNGVDKAGGYPRAAEDDSASPPGAASDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPEAAPAHGAATGRRRPPRRAYGRRARRGFHGPGARLPGAGGQAGPPAGRLGRVWLPQGHRALHARRLWPLRPGPR

SEQ ID NO: 762711 - protein, 95 aa, Homo sapiens
DASALASQSAGTVAVSHHARPPVLTHSGEWCPLVTPVGSVFSSCLPPVCLAFVPLDACGLSDPAHVESLQEKAQVALTEYVRAQYPSQPQRFGRL

SEQ ID NO: 762712 - protein, 402 aa, Homo sapiens [sequence omitted]

SEQ ID NO: 762713 - protein, 76 aa, Homo sapiens
GRSAPGEGCAGGDGCSPCRRGRAGVSCGGRAGAGSCGRQLRLLPPPSLRHDAGDRQAAHRGDAGGQPADKVFTRCI

SEQ ID NO: 762714 - protein, 760 aa, Homo sapiens
TAARRLEKAVRAGTAAALAGEGGPGSAAAGGPARGAVGGSCVSCHRPPSATMPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARNKTGLVSSTWDRQFYFTQGGNLMSQARGDVAGGLAMDIDNCSVMAVDCEDRRYCFQITSFDGKKSSILQAESKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTFPLPCVVLYATHQENKRLFGFVLRTSSGRSESNLSSVCYIFESNNEGEKICDSVGLAKQIALHAELDRRASEKQKEIERVKEKQQKELNKQKQIEKDLEEQSRLIAASSRPNQASSEGQFVVLSSSQSEESDLGEGGKKRESEA

SEQ ID NO: 762715 - protein, 80 aa, Homo sapiens
TAARRLEKAVRAGTAAALAGEGGPGSAAAGGPARGAVGGSCVSCHRPPSATMPGIDKLPIEETLEDSPQNRVQEAEQQRI

SEQ ID NO: 762716 - protein, 144 aa, Homo sapiens
MPPGGPHSAPRFFVKGAPKRGSRDNKSTEAQRARRRFKQQRAGKRGNTAVRSVWGISLCREREPLYFRWGRGRTIMAAEPSSLSQRDFTGARRAKLITLLHGGFYVVFKHQAAHILLRPALKKLRLNGTIVFSSKHLFPPGALW

SEQ ID NO: 762717 - protein, 760 aa, Homo sapiens; identical to SEQ ID NO: 762714

SEQ ID NO: 762718 - protein, 760 aa, Homo sapiens; identical to SEQ ID NO: 762714

SEQ ID NO: 762719 - protein, 360 aa, Homo sapiens
YYYKIRGRVDKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTFPLPCVVLYATHQENKRLFGFVLRTSSGRSESNLSSVCYIFESNNEGEKICDSVGLAKQIALHAELDRRASEKQKEIERVKEKQQKELNKQKQIEKDLEEQSRLIAASSRPNQASSEGQFVVLSSSQSEESDLGEGGKKRESEA

SEQ ID NO: 762720 - protein, 250 aa, Homo sapiens [sequence omitted]

SEQ ID NO: 762721 - protein, 725 aa, Homo sapiens
TAARRLEKAVRAGTAAALAGEGGPGSAAAGGPARGAVGGSCVSCHRPPSATMPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARNKTGLVSSTWDRQFYFTQGGNLMSQARGDVAGGLAMDIDNCSVMAVDCEDRRYCFQITSFDGKKSSILQAESKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTFPLPCVVLYATHQENKRLFGFVLRTSSGRSESNLSSVCYIFESNNEGEKICDSVGLAKQIALHAELDRRASEKQKEIERVKEKQQKELNKQKQIEKVYSPNVWIFMCCL

SEQ ID NO: 762722 - protein, 620 aa, Homo sapiens
TAARRLEKAVRAGTAAALAGEGGPGSAAAGGPARGAVGGSCVSCHRPPSATMPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARNKTGLVSSTWDRQFYFTQGGNLMSQARGDVAGGLAMDIDNCSVMAVDCEDRRYCFQITSFDGKKSSILQAESKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTVSST

SEQ ID NO: 762723 - protein, 350 aa, Homo sapiens
TAARRLEKAVRAGTAAALAGEGGPGSAAAGGPARGAVGGSCVSCHRPPSATMPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARKSDARLIDIAVY

SEQ ID NO: 762724 - protein, 148 aa, Homo sapiens
GRDFPHGRSAPGEGCAGGDGCSPCRRGRAGVSCGGRAGAGSCGRQLRLLPPPSLRHDAGDRQAAHRGDAGGQPAGEARELVGDEGEPSWPTPGLAPPRLPQVPAPAQVGAAAALGHRPSQAAPGVVEAGPAAQGPRGPARLGRGPQAE

SEQ ID NO: 762725 - protein, 66 aa, Homo sapiens
LFFVDIAIDRHLAIHRHLSIHRHQCSVQFKIMQCFTLELDLKNSTLCDHGIGIHVGWRTYFFILSQ

SEQ ID NO: 762726 - protein, 135 aa, Homo sapiens
ARRRPAGCRRRCLEEAVQPHQQVADLTMGRSALDRTTAQPEASGTPAAAQSPPGPWRPSGTGRCLLCSNPSGAPCPLSLPRRALPCEDYTRCFSSLPEDTASLGPLPCAKTPMTSVPNAVPSAVLWGAALSDFPG

SEQ ID NO: 762727 - protein, 83 aa, Homo sapiens
VVWRVYVNMRAPCAAGSGSAPILPHRAAQVWPQMSGARGFPAELRALFRPCGVTIADSVKSHALYEAERGFDAALFSSMQTSP

SEQ ID NO: 762728 - protein, 883 aa, Homo sapiens
PRPRRTSPPDAVISASHVLHRIHLLCCPCSRSSGQGYGTFPAHHNPDSQKPSRYLSHPSLSHHVKTFWGASASESPAEVRLGAHPGALLTHDSLLEVCDDYSLDDNEYFFDRHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMTTVGYGDIYPKTLLGKIVGGLCCIAGVLVIALPIPIIVNNFSEFYKEQKRQEKAIKRREALERAKRNGSIVSMNMKDAFARSIEMMDIVVEKNGENMGKKDKVQDNHLSPNKWKWTKRTLSETSSSKSFETKEQGSPEKARSSSSPQHLNVQQLEDMYNKMAKTQSQPILNTKESAAQSKPKEELEMESIPSPVAPLPTRTEGVIDMRSMSSIDSFISCATDFPEATRFSHSPLTSLPSKTGGSTAPEVGWRGALGASGGRFVEANPSPDASQHSSFFIESPKSSMKTNNPLKLRALKVNFMEGDPSPLLPVLGMYHDPLRNRGSAAAAVAGLECATLLDKAVLSPESSIYTTASAKTPPRSPEKHTAIAFNFEAGVHQYIDADTDDEGQLLYSVDSSPPKSLPGSTSPKFSTGTRSEKNHFESSPLPTSPKFLRQNCIYSTEALTGKGPSGQEKCKLENHISPDVRVLPGGGAHGSTRDQSI

SEQ ID NO: 762729 - protein, 131 aa, Homo sapiens
RHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKVSLGSGGCWSGGICLHPHIEDHCWRTLA

SEQ ID NO: 762730 - protein, 854 aa, Homo sapiens
MTKHGSRSTSSLPPEPMEIVRSKACSRRVRLNVGGLAHEVLWRTLDRLPRTRLGKLRDCNTHDSLLEVCDDYSLDDNEYFFDRHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMTTVGYGDIYPKTLLGKIVGGLCCIAGVLVIALPIPIIVNNFSEFYKEQKRQEKAIKRREALERAKRNGSIVSMNMKDAFARSIEMMDIVVEKNGENMGKKDKVQDNHLSPNKWKWTKRTLSETSSSKSFETKEQGSPEKARSSSSPQHLNVQQLEDMYNKMAKTQSQPILNTKESAAQSKPKEELEMESIPSPVAPLPTRTEGVIDMRSMSSIDSFISCATDFPEATRFSHSPLTSLPSKTGGSTAPEVGWRGALGASGGRFVEANPSPDASQHSSFFIESPKSSMKTNNPLKLRALKVNFMEGDPSPLLPVLGMYHDPLRNRGSAAAAVAGLECATLLDKAVLSPESSIYTTASAKTPPRSPEKHTAIAFNFEAGVHQYIDADTDDEGQLLYSVDSSPPKSLPGSTSPKFSTGTRSEKNHFESSPLPTSPKFLRQNCIYSTEALTGKGPSGQEKCKLENHISPDVRVLPGGGAHGSTRDQSI

SEQ ID NO: 762731 - protein, 446 aa, Homo sapiens
PRPRRTSPPDAVISASHVLHRIHLLCCPCSRSSGQGYGTFPAHHNPDSQKPSRYLSHPSLSHHVKTFWGASASESPAEVRLGAHPGALLTHDSLLEVCDDYSLDDNEYFFDRHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMTTVGYGDIYPKTLLGKIVGGLCCIAGVLVIALPIPIKTIICCVKRR

SEQ ID NO: 762732 - protein, 501 aa, Homo sapiens
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 762733 - protein, 96 aa, Homo sapiens
LSNQEHQWLFSRLQDVRDVSATFLSDLEENFENNIVVLQTLKNAWLQHYAVNSADPGVFVLLACGTMSSTCGQLASYPLALVRTRMQAQGKAGPGQ

SEQ ID NO: 762734 - protein, 469 aa, Homo sapiens
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 762735 - protein, 104 aa, Homo sapiens
MMKGEVTWPPRPDFPTYSIDANLAVKEEERIWPCGHWHLSPADGWGSRACLGVQGARAAWPGCTEGKCWGSWCSELAWTLSGWAPPQNQTHCPHCGMRAVEHHV

SEQ ID NO: 762736 - protein, 542 aa, Homo sapiens
PASPSPRSQLQSAWLASRAVTAGPPPPLPPAPGAPASRPMVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 762737 - protein, 542 aa, Homo sapiens; identical to SEQ ID NO: 762736

SEQ ID NO: 762738 - protein, 387 aa, Homo sapiens
PASPSPRSQLQSAWLASRAVTAGPPPPLPPAPGAPASRPMVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEFLNVKAVRCLSL

SEQ ID NO: 762739 - protein, 315 aa, Homo sapiens
CAIWHEAQIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 762740 - protein, 542 aa, Homo sapiens; identical to SEQ ID NO: 762736

SEQ ID NO: 762741 - protein, 104 aa, Homo sapiens; identical to SEQ ID NO: 762735

SEQ ID NO: 762742 - protein, 542 aa, Homo sapiens; identical to SEQ ID NO: 762736

SEQ ID NO: 762743 - protein, 542 aa, Homo sapiens; identical to SEQ ID NO: 762736

SEQ ID NO: 762744 - protein, 117 aa, Homo sapiens
SGGGVGRRAGPTSSRETGAGRAGDPAGEICAQSVRGRPGRPARGPGAFSEPSHSARPELGLVGGVIGPTSGPSRGPGRLPHGRGASPSTSGCRLCRGESASSQRGILSASQARLIRG

SEQ ID NO: 762745 - protein, 101 aa, Homo sapiens
AGAGSGAGRDPRPLARLGLAALGTPLEKFAPFSEPSHSARPELGLVGGVIGPTSGPSRGPGRLPHGRGASPSTSGCRLCRGESASSQRGILSASQARLIRG

SEQ ID NO: 762746 - protein, 565 aa, Homo sapiens
LFPCLPFGHLRKAPSSVRMATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 762747 - protein, 89 aa, Homo sapiens
FLLSYPPGPFSLRENRSLGAIQVESLWESDIVPISRSLCCHSLVEDEFLNSACPPPARSLELASFQPSARNQHSMKINSGPAHQQDLST

SEQ ID NO: 762748 - protein, 884 aa, Homo sapiens
MLGRRAPICPSRLCSRQKQWGKNRPELSDAGIRDQSWRGLGCALRFRTNKAFKLPNLWFDSTRAASLSHPGAHPLSSVAATEGGGACGAQTQLELLRGGLGLSQRGKGGGKEVGFLPANRRARPRCRSMPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 762749 - protein, 884 aa, Homo sapiens; identical to SEQ ID NO: 762748

SEQ ID NO: 762750 - protein, 884 aa, Homo sapiens; identical to SEQ ID NO: 762748

SEQ ID NO: 762751 - protein, 884 aa, Homo sapiens; identical to SEQ ID NO: 762748

SEQ ID NO: 762752 - protein, 690 aa, Homo sapiens
EGYRRPRLASRYVSPGPPGGREGQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 762753 - protein, 204 aa, Homo sapiens
SSRSRSKNYNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 762754 - protein, 698 aa, Homo sapiens
MLGRRAPICPSRLCSRQKQWGKNRPELSDAGIRDQSWRGLGCALRFRTNKAFKLPNLWFDSTRAASLSHPGAHPLSSVAATEGGGACGAQTQLELLRGGLGLSQRGKGGGKEVGFLPANRRARPRCRSMPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRASDWPNNPALSVAEPSS

SEQ ID NO: 762755 - protein, 542 aa, Homo sapiens
LFPCLPFGHLRKAPSSVRMATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNAGSSHFVPVFVAVLLTLGVVTIVLALMYVFREHQRSGSYHVREESTYLPLTSMQPTEAMGEEPSRAE

SEQ ID NO: 762756 - protein, 186 aa, Homo sapiens
MVPQAFLREIGGFGVFLGPDGFYVYTDDSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 762757 - protein, 884 aa, Homo sapiens; identical to SEQ ID NO: 762748

SEQ ID NO: 762758 - protein, 884 aa, Homo sapiens; identical to SEQ ID NO: 762748

SEQ ID NO: 762759 - protein, 884 aa, Homo sapiens; identical to SEQ ID NO: 762748

SEQ ID NO: 762760 - protein, 884 aa, Homo sapiens; identical to SEQ ID NO: 762748

SEQ ID NO: 762761 - protein, 297 aa, Homo sapiens
MLGRRAPICPSRLCSRQKQWGKNRPELSDAGIRDQSWRGLGCALRFRTNKAFKLPNLWFDSTRAASLSHPGAHPLSSVAATEGGGACGAQTQLELLRGGLGLSQRGKGGGKEVGFLPANRRARPRCRSMPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTARPALPPSPHLLLRCARLSGALLPHCSCNFGLSSALEVSLTSREDTETVSFFFNFDN

SEQ ID NO: 762762 - protein, 196 aa, Homo sapiens
EFPGQTTRPESSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 762763 - protein, 565 aa, Homo sapiens; identical to SEQ ID NO: 762746

SEQ ID NO: 762764 - protein, 168 aa, Homo sapiens
RGRAAAASAAAPGGWEPRRRARWRRECCAPAERPGPAASCSGRPPAASCPGSGEQRRPCPVGAGKGPPRGGGRGFPGAGLRPGPVPSAGGCPASGQWGRSWGGAGAGAGSGRPRAQGHGGDGPLCGSTLAREGPRGLARRPHPPRGAGPACRALTGATRGQGQGQRAP

SEQ ID NO: 762765 - protein, 286 aa, Homo sapiens
MAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762766 - protein, 298 aa, Homo sapiens
MEGGWGPRAGRRLQRREGGRRGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762767 - protein, 260 aa, Homo sapiens
REKMTESGRGYFGEGEDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762768 - protein, 211 aa, Homo sapiens
CWGDYRGSPARDAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762769 - protein, 158 aa, Homo sapiens
GTRCQEVLPKIHEDKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762770 - protein, 286 aa, Homo sapiens; identical to SEQ ID NO: 762765

SEQ ID NO: 762771 - protein, 286 aa, Homo sapiens; identical to SEQ ID NO: 762765

SEQ ID NO: 762772 - protein, 146 aa, Homo sapiens
MNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 762773 - protein, 160 aa, Homo sapiens
MAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEESAPVGVQFLE

SEQ ID NO: 762774 - protein, 157 aa, Homo sapiens
EGSRGGGVSGGARGVGAEAPSKMAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWICSGAES

SEQ ID NO: 762775 - protein, 64 aa, Homo sapiens
MVAPARPRVVRFPDGQQHGVLLSLALWAPCLSEAPPPAALSLAPSGPAAGSACGDRGEHWPGRP

SEQ ID NO: 762776 - protein, 1243 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762777 - protein, 1124 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDVVSENANYLRTPRTLVEQKQNPTVGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762778 - protein, 1185 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762779 - protein, 1200 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNTNDSQNEDGGMVKEMESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762780 - protein, 74 aa, Homo sapiens
MRNLIMPGLRRLLGFCFVSCALQTLNTCSTEGLVLERMTAWAWSDSTALRVLSRLDFSSCSPMASLFHFLGSRR

SEQ ID NO: 762781 - protein, 128 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGIKGSGGETPLSSLFIKLIHINCRL

SEQ ID NO: 762782 - protein, 1222 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762783 - protein, 255 aa, Homo sapiens
CPLSHFQEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 762784 - protein, 216 aa, Homo sapiens
RGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 762785 - protein, 216 aa, Homo sapiens; identical to SEQ ID NO: 762784

SEQ ID NO: 762786 - protein, 216 aa, Homo sapiens; identical to SEQ ID NO: 762784

SEQ ID NO: 762787 - protein, 216 aa, Homo sapiens; identical to SEQ ID NO: 762784

SEQ ID NO: 762788 - protein, 216 aa, Homo sapiens; identical to SEQ ID NO: 762784

SEQ ID NO: 762789 - protein, 216 aa, Homo sapiens; identical to SEQ ID NO: 762784

SEQ ID NO: 762790 - protein, 216 aa, Homo sapiens; identical to SEQ ID NO: 762784

SEQ ID NO: 762791 - protein, 182 aa, Homo sapiens
LTLDNMKELTMERNHMNVIYVEKPSLIVLTLDNMSEVTMERNHMDVIYVGKHSLNLLCLNDMREFTLERNHMSAMYVGKPSLNLLTSDDMRELTLEKNHMNAIYAEKPSITLLSLDDMRELTLERNHMNAIYVVKPSIEVTTLDFIEEFTLERNHMYVLYVGKPLVNFLTLDNMRELTLKKQ

SEQ ID NO: 762792 - protein, 163 aa, Homo sapiens
LTLDNMKELTMERNHMNVIYVEKPSLIVLTLDNMSEVTMERNHMDVIYVGKHSLNLLCLNDMREFTLERNHMSAMYVGKPSLNLLTSDDMRELTLEKNHMNAIYAEKPSITLLSLDDMRELTLERNHMNAIYVVKPSIEVTTLDFIEEFTLERNQHRQHSLKV

SEQ ID NO: 762793 - protein, 120 aa, Homo sapiens [sequence omitted]

SEQ ID NO: 762794 - protein, 114 aa, Homo sapiens
YYYYIRGRVDGVPGVCTQGDPGVRGRTCGKNHWSLLPREGLKKPNVVGDGGSQALADVTAALSTFRTRTPRSSSGTPLSALTLVPSSAEGLLGYGLKSEVTLKRNLYLSVLLHC

SEQ ID NO: 762795 - protein, 198 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVGHPVWHYVSK

SEQ ID NO: 762796 - protein, 160 aa, Homo sapiens
YRAGYQFRRRLSHTASPVLVERDGKLYGRGSTDDKGPVAGWINALEAYQKTGQEIPVNVRFCLEGMEESGSEGLDELIFARKDTFFKDVDYVCISDNYCQLLFLPRTFEICGLGSGRKMAALTTLFKYIDENQDRYIKKLAKWVAIQSVSAWPEKRVSVE

SEQ ID NO: 762797 - protein, 475 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762798 - protein, 475 aa, Homo sapiens; identical to SEQ ID NO: 762797

SEQ ID NO: 762799 - protein, 475 aa, Homo sapiens; identical to SEQ ID NO: 762797

SEQ ID NO: 762800 - protein, 400 aa, Homo sapiens [sequence omitted]

SEQ ID NO: 762801 - protein, 430 aa, Homo sapiens [sequence omitted]

SEQ ID NO: 762802 - protein, 466 aa, Homo sapiens
MTSPDRYVQSVDIYGGFIHEVVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762803 - protein, 440 aa, Homo sapiens
MVMMIFILNLLLNVTICCQLKLPRELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762804 - protein, 475 aa, Homo sapiens; identical to SEQ ID NO: 762797

SEQ ID NO: 762805 - protein, 475 aa, Homo sapiens; identical to SEQ ID NO: 762797

SEQ ID NO: 762806 - protein, 475 aa, Homo sapiens; identical to SEQ ID NO: 762797

SEQ ID NO: 762807 - protein, 318 aa, Homo sapiens
VPPTAGCMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762808 - protein, 475 aa, Homo sapiens; identical to SEQ ID NO: 762797

SEQ ID NO: 762809 - protein, 484 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEAEAGGSLETKSLSLR

SEQ ID NO: 762810 - protein, 160 aa, Homo sapiens
SLFIYLIYFYCSAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762811 - protein, 287 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLSLSAGPVLFSRPSPLLVFSCLLFSMIPQNLTNWKDDFVSVCTPK

SEQ ID NO: 762812 - protein, 157 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQVCPPR

SEQ ID NO: 762813 - protein, 223 aa, Homo sapiens
PRVRGRVGGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762814 - protein, 71 aa, Homo sapiens
YVCISDNYWLGKKKPCITYGLRGICYFFIEGTVPSCTGHFFLTPESPGSPKRKVDKDPEVRCTGRRSTGLT

SEQ ID NO: 762815 - protein, 475 aa, Homo sapiens; identical to SEQ ID NO: 762797

SEQ ID NO: 762816 - protein, 475 aa, Homo sapiens; identical to SEQ ID NO: 762797

SEQ ID NO: 762817 - protein, 475 aa, Homo sapiens; identical to SEQ ID NO: 762797

SEQ ID NO: 762818 - protein, 475 aa, Homo sapiens; identical to SEQ ID NO: 762797

SEQ ID NO: 762819 - protein, 475 aa, Homo sapiens; identical to SEQ ID NO: 762797

SEQ ID NO: 762820 - protein, 514 aa, Homo sapiens
MAALTTLFKYIDENQDRYIKPVQLQQPQRVSLERGNVTGASSPSRTPFQNPSLLLVHKQKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762821 - protein, 475 aa, Homo sapiens; identical to SEQ ID NO: 762797

SEQ ID NO: 762822 - protein, 376 aa, Homo sapiens
YRAGYQFRRRLSHTASPVLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762823 - protein, 548 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEGTVPSCTGHFFLTPESPGSPKRKVDKDPEVRCTGRRSTGLTCAPIPSFHKPPSYTRVDSNTSSDQKLIHSSIKVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 762824 - protein, 475 aa, Homo sapiens; identical to SEQ ID NO: 762797

SEQ ID NO: 762825 - protein, 90 aa, Homo sapiens
IRGRVDRQKGAGRRAMKTVFGVEPDLTREGGSIPVTLTFQEATGKNVMLLPVGSADDGAHSQNEKLNRYNYIEGTKMLAAYLYEVSQLKD

SEQ ID NO: 762826 - protein, 298 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSWVAEGDLCPGYEPGASERPSVATPCYGCPLGGPRAKTPAGALPEAPGPL

SEQ ID NO: 762827 - protein, 163 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQLLKGHNIGDSA

SEQ ID NO: 762828 - protein, 72 aa, Homo sapiens
GGVVARATAGRASAGGRGQDTWYGTGAALAAGNRALPSGPSFPGRPSVSTRDRTDQLLFLPRTFEICGLGSG

SEQ ID NO: 762829 - protein, 66 aa, Homo sapiens
APKLGWGMLPRKKAECVWAREESPHTWVLAHDTSQHNDVFLSTRYNYIEGTKMLAAYLYEVSQLKD

SEQ ID NO: 762830 - protein, 614 aa, Homo sapiens
LPRTCQRGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETNAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 762831 - protein, 188 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 762832 - protein, 128 aa, Homo sapiens
LTTSAAECPHATEVSLEFGNLYQQRKILMYSLSVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 762833 - protein, 485 aa, Homo sapiens
PSADSRPSPNWAAGFQLEGLLSLSLRAALTIGGQDGGGALGRRPPPGVKVSDCRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762834 - protein, 298 aa, Homo sapiens
EKVVAGCVLNRTSRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWWPVRGDLWFHNFWPWPPPTPSGPPRAGQAIPSDSVDPPLDHW

SEQ ID NO: 762835 - protein, 434 aa, Homo sapiens
MIRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762836 - protein, 485 aa, Homo sapiens; identical to SEQ ID NO: 762833

SEQ ID NO: 762837 - protein, 508 aa, Homo sapiens
PSADSRPSPNWAAGFQLEGLLSLSLRAALTIGGQDGGGALGRRPPPGVKVSDCRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLVAGAERTVGEAQELPLMLWVSPEISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762838 - protein, 304 aa, Homo sapiens [sequence omitted]

SEQ ID NO: 762839 - protein, 297 aa, Homo sapiens
MRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762840 - protein, 171 aa, Homo sapiens
RLLRGSPLDSGWGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762841 - protein, 338 aa, Homo sapiens
PSADSRPSPNWAAGFQLEGLLSLSLRAALTIGGQDGGGALGRRPPPGVKVSDCRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWWPVRGDLWFHNFWPWPPPTPSGPPRAGQAIPSDSVDPPLDHW

SEQ ID NO: 762842 - protein, 190 aa, Homo sapiens
PSADSRPSPNWAAGFQLEGLLSLSLRAALTIGGQDGGGALGRRPPPGVKVSDCRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHISEAVFLAPVSRRPPTSCWPCP

SEQ ID NO: 762843 - protein, 441 aa, Homo sapiens
AGTPRIVRDRQTRRQRSSRRPWLLCLPPQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762844 - protein, 304 aa, Homo sapiens [sequence omitted]

SEQ ID NO: 762845 - protein, 406 aa, Homo sapiens
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762846 - protein, 451 aa, Homo sapiens
HPPGPWRPSCKGCAPGSRHAGRLRACGPPCPHCPPASAQAPASFRMTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762847 - protein, 297 aa, Homo sapiens; identical to SEQ ID NO: 762839

SEQ ID NO: 762848 - protein, 321 aa, Homo sapiens
MSTGLSSQPPLWDAAASYAPPSLRMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 762849 - protein, 204 aa, Homo sapiens [sequence omitted]

SEQ ID NO: 762850 - protein, 190 aa, Homo sapiens; identical to SEQ ID NO: 762842

SEQ ID NO: 762851 - protein, 122 aa, Homo sapiens
LRSDPSDRKSHVRYLPSEDLNVLLGHLKPTVLQTERQQVQSPKDYKGMLLTIILVTKAAKLFLYLGTVFPDKPENSDKATSLGIRTEKARVMEISPALSQEKVSALQTAPTEVAALPAACRC

SEQ ID NO: 762852 - protein, 117 aa, Homo sapiens
MGVLRAKGGKRGSLSVPVSVRGASSPAMRVQRARGGKGEVRSPRLAGIASPTAIVVPRARRGRGVGSESPPRGGLPPPTAMGVPRARGEEGMDLSHHKMGGLYIQVLPKNQLICFLY

SEQ ID NO: 762853 - protein, 115 aa, Homo sapiens [sequence omitted]

SEQ ID NO: 762854 - protein, 81 aa, Homo sapiens
NGSSRESTRNLNLDSGFQCGLRLPPPRPSACLAARCDLHAKESSSDGCTLPTGVAPGGLGGASRLRALSAAFLLQMILEGR

SEQ ID NO: 762855 - protein, 81 aa, Homo sapiens; identical to SEQ ID NO: 762854

SEQ ID NO: 762856 - protein, 100 aa, Homo sapiens
QTNKQTNKHHGSHWKVFPLEDAPICHRGPISDFCFIFNPFMVQMRKPDQEGSDFPQITAPVPSLSDLYSGLCLAPVRSFFPHSCKGQRSKIQGSAGPCSL

SEQ ID NO: 762857 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 762858 - protein, 624 aa, Homo sapiens
WIVKCVYCNNMQCLDYLLKYGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 762859 - protein, 664 aa, Homo sapiens; identical to SEQ ID NO: 762857

SEQ ID NO: 762860 - protein, 180 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRENLFA

SEQ ID NO: 762861 - protein, 372 aa, Homo sapiens
FERPPGQVRAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 762862 - protein, 664 aa, Homo sapiens; identical to SEQ ID NO: 762857

SEQ ID NO: 762863 - protein, 664 aa, Homo sapiens; identical to SEQ ID NO: 762857

SEQ ID NO: 762864 - protein, 399 aa, Homo sapiens
IHTGENPYECHECGKAFSRKYQLISHQRTHAGEKPYECTDCGKAFGLKSQLIIHQRTHTGEKPFECSECQKAFNTKSNLIVHQRTHTGEKPYGCNECGKAFTFKSQLIVHQRVHAGVKPYGCSQCEKTFNLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTTEKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 762865 - protein, 108 aa, Homo sapiens
MWPSQLSHAFQPRRPGEPRSFQAVLPPELWIHLAVVACGNRLEETLVMLKSAVLFSHRKIQFHIFTEDSLKPEFDKQLRQWPDSYTKKFEHRIYPITFSVGNPQEWKK

SEQ ID NO: 762866 - protein, 72 aa, Homo sapiens
GFTLGTPGPMSTLRARLLPQMAGVRGGGGRQLAPGLPAASSPGPKQPWLHGQGEEEGVLPVSPGPRFPQEGK

SEQ ID NO: 762867 - protein, 407 aa, Homo sapiens
MDGLPGRALGAACLLLLAAGWLGPEAWGSPTPPPTPAAPPPPPPPGAPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 762868 - protein, 101 aa, Homo sapiens
IYKELKQLYKKTNNTIKNWAKGMNRHFSKEDIHATNKLMKNSSTSLIIREMQFKTTMRYHLMPVTMVIIKMSGNDRCWRGCGKIGILLHCWWECKLVQQLW

SEQ ID NO: 762869 - protein, 176 aa, Homo sapiens
MSLKPFTYPFPETRFLHAGPNVYKFKIRYGKSIRGEEIENKEVITQELEVPVEKKAVGAVMRKRKHMDEPSSPSRPGLDRAKIGTSSQGPSKKKPPVETRRNRERKTQQGLQETLASDITDVQKQDSEWGHSLPGRIVPPLQHNSPPPKERAATGFFGFLSSLFPFRYFFRKSSHS

SEQ ID NO: 762870 - protein, 182 aa, Homo sapiens
MSLKPFTYPFPETRFLHAGPNVYKFKIRYGKSIRGEEIENKEVITQELEVPVEKKAVGAVMRKRKHMDEPSSPSRPGLDRAKIGTSSQGPSKKKPPVETRRNRERKTQQGLQETLASDITDVQKQDSEWGHSLPGRIVPPLQHNSPPPKERAATGFFGFLRSHHLSHARGCPSRVGEQGLNC

SEQ ID NO: 762871 - protein, 86 aa, Homo sapiens
NIQPYLKILQDQFQTTAMKSILQQSAQKSWSSFPCFHPHNWRVHGALQGMTVVPCRAAFLSKCEFMSVIETAVSHRKACVQQVANR

SEQ ID NO: 762872 - protein, 338 aa, Homo sapiens
MYHPAYWVVFSATTALLFIPGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 762873 - protein, 361 aa, Homo sapiens
PGLCGCRSPGKLWLSRMGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 762874 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 762875 - protein, 202 aa, Homo sapiens; identical to SEQ ID NO: 762874

SEQ ID NO: 762876 - protein, 121 aa, Homo sapiens
KANGTRETKSGTIGPFGLVLTAGYNNYGKRTDNIKSQGSGVLTGPGWVQTHTGIPECVPQQDTPALKEWTEEELTWDYDPNSAGPPLPAPGLWSENVAAGENNAAKHSRGTGNAHLLTGYF

SEQ ID NO: 762877 - protein, 1049 aa, Homo sapiens
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 762878 - protein, 1049 aa, Homo sapiens; identical to SEQ ID NO: 762877

SEQ ID NO: 762879 - protein, 125 aa, Homo sapiens
MAAATAAAALAAADPPPAMPQAAGAGGPTTRRDFYWLRSFLAGGIAGCCAKTTVAPLDRVKVLLQDSISKKKKKKKDTSVRLSVKGDCKYLLNKNLHSICYRIQRILKINFIHVLTISFFQLFTY

SEQ ID NO: 762880 - protein, 332 aa, Homo sapiens
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 762881 - protein, 332 aa, Homo sapiens; identical to SEQ ID NO: 762880

SEQ ID NO: 762882 - protein, 234 aa, Homo sapiens
MMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 762883 - protein, 281 aa, Homo sapiens
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCL

SEQ ID NO: 762884 - protein, 125 aa, Homo sapiens [sequence omitted]

SEQ ID NO: 762885 - protein, 234 aa, Homo sapiens; identical to SEQ ID NO: 762882

SEQ ID NO: 762886 - protein, 234 aa, Homo sapiens; identical to SEQ ID NO: 762882

SEQ ID NO: 762887 - protein, 180 aa, Homo sapiens
MVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 762888 - protein, 214 aa, Homo sapiens
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFCTNH

SEQ ID NO: 762889 - protein, 603 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762890 - protein, 566 aa, Homo sapiens
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762891 - protein, 434 aa, Homo sapiens
MRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762892 - protein, 603 aa, Homo sapiens; identical to SEQ ID NO: 762889

SEQ ID NO: 762893 - protein, 702 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIVWYTPAAMLPASVLGAWGRPGRGPEGQTASKSTGKAGIVHSPLGSQAQTWGLWDEQLKTNAGRAAGQQATDGPDSGLGPPEQAVPTDLCGAHSPRDTTEGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762894 - protein, 386 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSK

SEQ ID NO: 762895 - protein, 725 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIVWYTPAAMLPASVLGAWGRPGRGPEGQTASKSTGKAGIVHSPLGSQAQTWGLWDEQLKTNAGRAAGQQATDGPDSGLGPPEQAVPTDLCGAHSPRDTTEVGSCPGVMSLGHWTGTLTVALPAGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762896 - protein, 603 aa, Homo sapiens; identical to SEQ ID NO: 762889

SEQ ID NO: 762897 - protein, 603 aa, Homo sapiens; identical to SEQ ID NO: 762889

SEQ ID NO: 762898 - protein, 316 aa, Homo sapiens
SSGINAECPLRPGHRLPAAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762899 - protein, 752 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQVRAGLGAGLPSWGLAPGAHLARAPAAQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIVWYTPAAMLPASVLGAWGRPGRGPEGQTASKSTGKAGIVHSPLGSQAQTWGLWDEQLKTNAGRAAGQQATDGPDSGLGPPEQAVPTDLCGAHSPRDTTEVGSCPGVMSLGHWTGTLTVALPAGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762900 - protein, 613 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKAITTAAPAEQIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFHQMAASPKPKQDGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762901 - protein, 521 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLGEHGRRVDPAPAPRRQPVQPRPPHTPSRCCPACGTSPMTCLAVGSPRPASSRGTCTASEISPPARCCGSTMPSSQQGRLATAGLGGVPGAAQLLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762902 - protein, 465 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRAVAWTAGRPKAGG

SEQ ID NO: 762903 - protein, 113 aa, Homo sapiens
WTGTLTVALPAGIKQILPHQMTTAGPVLGEGRGSDAFFDALDHVIDIHGHIIGMGLSPDNRWASCQCPRRGARRRPTPSTVPLAQVPVREQPRLAQRCGGGRPHAAATNRGGD

SEQ ID NO: 762904 - protein, 238 aa, Homo sapiens
AVLWVLAAAGLDVLAVWPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALQSRRSEQAYEVLAVEHGTAHMGTCTHLEINPAGA

SEQ ID NO: 762905 - protein, 613 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKAITTAAPAEQIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762906 - protein, 627 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLGEHGRRVDPAPAPRTTACPAPASPHSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762907 - protein, 583 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVARLRHEDVVNSVVFSPQEQELLLTASDDATIKAWRSPRTMRVLQAPRPRPRTFFSWLASQRR

SEQ ID NO: 762908 - protein, 592 aa, Homo sapiens
MYPWAYFISSIHASVVTGAGAYVTEIAADGPPGQNVTMDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 762909 - protein, 367 aa, Homo sapiens [sequence omitted]

SEQ ID NO: 762910 - protein, 527 aa, Homo sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEKPLIISERIQKADPQGPELGEACEKGNMLKRQRIKREKKDFRQVIVNDCHLPESFKEEENQKCKKSGGKYSLNSGAVKNPKTQLGQKPFTCSVCGKGFSQSANLVVHQRIHTGEKPFECHECGKAFIQSANLVVHQRIHTGQKPYVCSKCGKAFTQSSNLTVHQKIHSLEKTFKCNECEKAFSYSSQLARHQKVHITEKCYECNECGKTFTRSSNLIVHQRIHTGEKPFACNDCGKAFTQSANLIVHQRSHTGEKPYECKECGKAFSCFSHLIVHQRIHTAEKPYDCSECGKAFSQLSCLIVHQRIHSGDLPYVCNECGKAFTCSSYLLIHQRIHNGEKPYTCNECGKAFRQRSSLTVHQRTHTGEKPYECEKCGAAFISNSHLMRHHRTHLVE

SEQ ID NO: 762911 - protein, 499 aa, Homo sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEKPLIISERIQKADPQGPELGEACEKGNMLKRQRIKREKKDFRQVIVNDCHLPESFKEEENQKCKKSGGKYSLNSGAVKNPKTQLGQKPFTCSVCGKGFSQSANLVVHQRIHTGEKPFECHECGKAFIQSANLVVHQRIHTGQKPYVCSKCGKAFTQSSNLTVHQKIHSLEKTFKCNECEKAFSYSSQLARHQKVHITEKCYECNECGKTFTRSSNLIVHQRIHTGEKPFACNDCGKAFTQSANLIVHQRSHTGEKPYECKECGKAFSCFSHLIVHQRIHSGDLPYVCNECGKAFTCSSYLLIHQRIHNGEKPYTCNECGKAFRQRSSLTVHQRTHTGEKPYECEKCGAAFISNSHLMRHHRTHLVE

SEQ ID NO: 762912 - protein, 106 aa, Homo sapiens
IFHVVFPGADEGCSAEREPPGKPLAYSSSNIGDLRPSCLFCVCVASDLQLLGRAALWVADGPCCHSHRPWCALEDLHAVKRAGCASHQSLGEVQEAAFSCFFQKLA

SEQ ID NO: 762913 - protein, 38 aa, Homo sapiens
LSSNYPWANCALFRWSLACWCLLVLVSVFFHSSRSPAA

SEQ ID NO: 762914 - protein, 90 aa, Homo sapiens
AASLGTARVRSGRAECTAKLAGDGHARLASAFLHRRAALPPPLGTCRPRLGEGGSAPALGPSPRRGRRVSEGLRDSLPPLGSLTLGKSPK

SEQ ID NO: 762915 - protein, 152 aa, Homo sapiens
MVLLAGPAALEGKRRRPKQGHSRCPAGTGPGPGRGPRPLPVPFPFAFFQPLLRSPQLSFANPRELKTSRPLFWGGWGVGEREWVEAGGIKNRNSFTSELRLTLWFQRALCSVLKSGTHYLITKKLHEISPPPPQHPLGKGTSKHPSKKETYT

SEQ ID NO: 762916 - protein, 252 aa, Homo sapiens
MAPWLQLLSLLGLLPGAVAAPAQPRAASFQAWGPPSPELLAPTRFALEMFNRGRAAGTRAVLGLVRGRVRRAGQGSLYSLEATLEEPPCNDPMVCRLPVSKKTLLCSFQVLDELGRHVLLRKDCGPVDTKVPGAGEPKSAFTQGSAMISSLSQNHPDNRNETFSSVISLLNEDPLSQDLPVKMASIFKNFVITYNRTYESKEEARWRLSVFVNNMVRAQKIQALDRGTAQYGAIHSVHSGGARSPTDWVPSS

SEQ ID NO: 762917 - protein, 291 aa, Homo sapiens
MAPWLQLLSLLGLLPGAVAAPAQPRAASFQAWGPPSPELLAPTRFALEMFNRGRAAGTRAVLGLVRGRVRRAGQGSLYSLEATLEEPPCNDPMVCRLPVSKKTLLCSFQVLDELGRHVLLRKDCGPVDTKVPGAGEPKSAFTQGSAMISSLSQNHPDNRNETFSSVISLLNEDPLSQDLPVKMASIFKNFVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGM

SEQ ID NO: 762918 - protein, 142 aa, Homo sapiens
RRPPRGRPVPAPVSAAAPCWSSRAAQASAPSTRPRSPGPRAPTGRASCEGPGADSSAACRATGPSLGRPAPRSSGPGRLRVPVLGAVPSLSPRPAAPGLMPAGSVCSAGDVGELWGEEQRGGSEARTSPPRRLRYPLGGPGL

SEQ ID NO: 762919 - protein, 75 aa, Homo sapiens
RVRPRVRFRVPFHKLVSGGTRGLAACTVAVHLGGGVDLSRGSVTNQAPNYARPLPGGHPTLWTGPMEATGRAAGV

SEQ ID NO: 762920 - protein, 142 aa, Homo sapiens; identical to SEQ ID NO: 762918

SEQ ID NO: 762921 - protein, 78 aa, Homo sapiens
MTSALGFSSPCGTGASERAKGKVGLGGSGNLSSSPVWPGSAVSVPPGPQQLSCSCQQEGLALIKSGQTEKTYSLTLQK

SEQ ID NO: 762922 - protein, 98 aa, Homo sapiens
PGPEGSEVGEADGEAEAAAEEREEAAVAAPTPSGKVDPAPERRFLELGNGLGEGEAPPPTLGVLGNDLGPGFLLSLRDRSLRKGQGQGGLGGLWESQL

SEQ ID NO: 762923 - protein, 143 aa, Homo sapiens
VTFPTRSGVGFRGARRTGCSAPSVRLRLSSRTKQVVSLQFPTWQGGLIDMDKKSTHRNPEDARAGKYEGKHKRKKRRKQNQNQHRSRHRSVTSFSSDDPMFPSSSSSSSGSQTDSSIEDAAKGKIKKKRREKTNKWEKRKDKI

SEQ ID NO: 762924 - protein, 124 aa, Homo sapiens
MDKKSTHRNPEDARAGKYEGKHKRKKRRKQNQNQHRSRHRSVTSFSSDDPMFPSSSSSSSGSQTDSSIEDAAKGKIKKKRREKTNKWEKRKSLVLLLRLECNDATSAHCNLCLPDSSNSPATAS

SEQ ID NO: 762925 - protein, 142 aa, Homo sapiens
VTFPTRSGVGFRGARRTGCSAPSVRLRLSSRTKQVVSLQFPTWQGGLIDMDKKSTHRNPEDARAGKYEGKHKRKKRRKQNQNQHRSRHRSVTSFSSDDPMFPSSSSSSSGSQTDSSIEDAAKGKIKKKRREKTNKWEKRKVR

SEQ ID NO: 762926 - protein, 143 aa, Homo sapiens; identical to SEQ ID NO: 762923

SEQ ID NO: 762927 - protein, 106 aa, Homo sapiens
MDKKSTHRNPEDARAGKYEGKHKRKKRRKQNQNQHRSRHRSVTSFSSDDPMFPSSSSSSSGSQTDSSIEDAAKGKIKKKRREKTNKWEKRKSLVLLLRLECNVAVS

SEQ ID NO: 762928 - protein, 143 aa, Homo sapiens; identical to SEQ ID NO: 762923

SEQ ID NO: 762929 - protein, 131 aa, Homo sapiens
EGSMRSAHIIQFKVIRLHFFPKKLLKTEEEGRMQGTRKKNCQSFKCQRIINTQEQIIPAASLGFVFFSPVFRISAGAPLCHIQFLFPDLRVLSLQMFLFISKKLCHFSLPPPRWYPPYCRRNVIFEALLAS

SEQ ID NO: 762930 - protein, 108 aa, Homo sapiens
LGPVPRGIISNTLDKMYKARVGSSKVTAVVRWKVSLRERTNEFVQLKLFKYIYSCHLSSQQLFPGDMAKGPGKCTGLSQGLSILLPKIFSPLVLGICFFSGSLLLLSW

SEQ ID NO: 762931 - protein, 104 aa, Homo sapiens
PEFHPRLPELEIPEVGTGNMHFKCPQQILRHNQARQLFNNLSVFPLQLYIPEDSILLVEKEITKVQYLAFTRTSINTCSLNPFLKELWTSGARRHQRSLSSPLK

SEQ ID NO: 762932 - protein, 112 aa, Homo sapiens
MVGRWSIDSSLIWYIFRSMCYGIDRYLVSVSLPLSLSFFFLSLTLKNRAVFGEEEKPGESSQVILKNAKLNQASKFCTRDLFRALTLLRSIMGRARWLTPIIPALWEAEAGG

SEQ ID NO: 762933 - protein, 182 aa, Homo sapiens
MSGRSVPHAHPATAEYEFANPSRLGEQRFGEGLLPEEILTPTLYHGYYVRPRAAPAGEGSRAGASELRLSEGKFQAFLDVSHFTPDEVTVRTVDNLLEVSARHPQRLDRHGFVSREFCRTYVLPADVDPWRVRAALSHDGILNLEAPRGGRHLDTEVNEVYISLLPAPPDPEEEEEAAIVEP

SEQ ID NO: 762934 - protein, 182 aa, Homo sapiens; identical to SEQ ID NO: 762933

SEQ ID NO: 762935 - protein, 536 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762936 - protein, 390 aa, Homo sapiens
FDGDSLQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762937 - protein, 353 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762938 - protein, 631 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELV

SEQ ID NO: 762939 - protein, 638 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762940 - protein, 574 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762941 - protein, 323 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 762942 - protein, 124 aa, Homo sapiens
MTRDRTETFSTSTLGGRKFTFLSKNTKPEAEISGSDREDSLFPLGLWTGCNNGMRPWGRNECLLCVGKRGKQIFGDLKRRPWQNLISCSTILFSFSPGHTAMHFPAILVVRCPVTVLRMEYGQM

SEQ ID NO: 762943 - protein, 1745 aa, Homo sapiens
QSGVSLLWAAPGQAMRKVCCYEDSMRRPVRSAFPCAWLIAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762944 - protein, 1716 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762945 - protein, 1753 aa, Homo sapiens
PAKPEAPKKQRSPAPPEELVTPGSTGPKSDLTGEQQSKSPVPGVKQEAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKGSCRAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762946 - protein, 1367 aa, Homo sapiens
EAPRSKRKLLKAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762947 - protein, 1439 aa, Homo sapiens
LQALYLPGSTTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762948 - protein, 1578 aa, Homo sapiens
SLSWLSSSRRLRGLTHPAQRFWKPGVSTIIMEQSELLAGLESPIHQADEKGEELAVEAGRHALKALLVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762949 - protein, 1819 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRVRLEEELRPVPGRARRGLVPCVGPVNAGGRQAWLEWIGEAGMLASWCRGNQEQAIIRASSVPWETRLPPASLGLPLTHPLPSPHLLHLCFWVSLYMHPILAPELGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762950 - protein, 777 aa, Homo sapiens
REFVLVLREFLLVLGFVLVLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762951 - protein, 1731 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSLQDMVTKYQKRKNKLEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762952 - protein, 1731 aa, Homo sapiens; identical to SEQ ID NO: 762951

SEQ ID NO: 762953 - protein, 1731 aa, Homo sapiens; identical to SEQ ID NO: 762951

SEQ ID NO: 762954 - protein, 182 aa, Homo sapiens
VTLEILLVIGREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762955 - protein, 1731 aa, Homo sapiens; identical to SEQ ID NO: 762951

SEQ ID NO: 762956 - protein, 102 aa, Homo sapiens
SSSSSSGSEASSEHKRRKKGRSRKSKKSKSRRKRTETESESSSSSSSGSTVSSHSCSSVKKGPAAESEETGQTHRPSRKEEKKRKKEVDSLMMRYLYRPESD

SEQ ID NO: 762957 - protein, 1731 aa, Homo sapiens; identical to SEQ ID NO: 762951

SEQ ID NO: 762958 - protein, 1526 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLEVGSHFSR

SEQ ID NO: 762959 - protein, 1404 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQVSTESTRLIQAQQSLPFHSLSLSRSSQWFLSPWEGK

SEQ ID NO: 762960 - protein, 1400 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLPSETAMERMPPPSKETGERDDEGAEGRQRVRKRSTRGAPHSPAYGTQTARPHTHLRQPPPQTQGPPAWAQKRPTPYSPPRKCRPGARLTPTTTEAPPPSAPTHTSHPRHSGQPPQTNQPTTRHHTPPATTQHLGTSPPPNTQRPARREQQ

SEQ ID NO: 762961 - protein, 102 aa, Homo sapiens; identical to SEQ ID NO: 762956

SEQ ID NO: 762962 - protein, 1734 aa, Homo sapiens
QSGVSLLWAAPGQAMRLDSEAASHAHSQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762963 - protein, 1641 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762964 - protein, 1259 aa, Homo sapiens
NTVCFLGSCFIWDDGGSSCTAQKEVGLADLRAPSQPTHKAVPHNVTPMLTTAGLLSQENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762965 - protein, 591 aa, Homo sapiens
MVRNHELVEEAEERFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762966 - protein, 337 aa, Homo sapiens
MVEHCRFQDRKPWTCRIDDYLPQAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 762967 - protein, 1731 aa, Homo sapiens; identical to SEQ ID NO: 762951

SEQ ID NO: 762968 - protein, 115 aa, Homo sapiens
MSSPSSPFREQSFLCAAGDAGEESRVQVLKNEVRRGSPVLLGWVEQAYADKCVCGPSAPPAPTPPSLSQRVMCNDLFKVNPFQLQQFRADPSTASLLLCPGGLDHKLNLRGKAWG

SEQ ID NO: 762969 - protein, 115 aa, Homo sapiens; identical to SEQ ID NO: 762968

SEQ ID NO: 762970 - protein, 1731 aa, Homo sapiens; identical to SEQ ID NO: 762951

SEQ ID NO: 762971 - protein, 1287 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKT

SEQ ID NO: 762972 - protein, 1019 aa, Homo sapiens
MYSASSLQGQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQCGA

SEQ ID NO: 762973 - protein, 393 aa, Homo sapiens
RREASHSDCITMEPRAGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPRDARVSDLKRALRELGSVPLRLTWQGPRRRAFLHYPDSAAAQQAVSCLQGLRLGTDTLRVALARQQRDK

SEQ ID NO: 762974 - protein, 220 aa, Homo sapiens [sequence omitted]

SEQ ID NO: 762975 - protein, 419 aa, Homo sapiens
RREASHSDCITMEPRAGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQVPPERLGRQDRISKTCSIGNCLTSSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPRDARVSDLKRALRELGSVPLRLTWQGPRRRAFLHYPDSAAAQQAVSCLQGLRLGTDTLRVALARQQRDK

SEQ ID NO: 762976 - protein, 286 aa, Homo sapiens
WAFGGHFCENFYRLARDIGFKFLLPLDLMENPLLSDAPDRTAILILGCLLGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPRDARVSDLKRALRELGSVPLRLTWQGPRRRAFLHYPDSAAAQQAVSCLQGLRLGTDTLRVALARQQRDK

SEQ ID NO: 762977 - protein, 180 aa, Homo sapiens
MHSSSSRPRLSLHTAQQAEGAGLGQSRKGLPQCSCGMKGSSSTARVGAKAEEAPRGTEGCQQLSPFKGSYLACQNIKDLDVFARTQEVKVDPDKPLEGVRLLVLQSKKTLLVPTPRLRTGLFNKITPPPGATKDILRKCATSQVPPERLGRQDRISKTCSIGNCLTSSNWSVPAPVDPAR

SEQ ID NO: 762978 - protein, 239 aa, Homo sapiens
RREASHSDCITMEPRAGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKIR

SEQ ID NO: 762979 - protein, 393 aa, Homo sapiens
RREASHSDCITMEPRAGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPRDARVSDLKRALRELGSVPLRLTWQGPRRRAFLHYPDSAAAQQAVSCLQGLRLGTDTLRVALARQQRDK

SEQ ID NO: 762980 - protein, 321 aa, Homo sapiens
CAGKRRTATASPWSRGQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPRDARVSDLKRALRELGSVPLRLTWQGPRRRAFLHYPDSAAAQQAVSCLQGLRLGTDTLRVALARQQRDK

SEQ ID NO: 762981 - protein, 393 aa, Homo sapiens; identical to SEQ ID NO: 762973

SEQ ID NO: 762982 - protein, 464 aa, Homo sapiens [sequence omitted]

SEQ ID NO: 762983 - protein, 707 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKIFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 762984 - protein, 707 aa, Homo sapiens; identical to SEQ ID NO: 762983

SEQ ID NO: 762985 - protein, 481 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKIFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTLHSQRAPRR

SEQ ID NO: 762986 - protein, 482 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKIFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDIMNRAPCRREI

SEQ ID NO: 762987 - protein, 464 aa, Homo sapiens [sequence omitted]

SEQ ID NO: 762988 - protein, 318 aa, Homo sapiens [sequence omitted]

SEQ ID NO: 762989 - protein, 211 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKSSHMVL

SEQ ID NO: 762990 - protein, 707 aa, Homo sapiens; identical to SEQ ID NO: 762983

SEQ ID NO: 762991 - protein, 650 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSAKASLFQLWFEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPLPKGTPPLTPSDSPQTRTASGAVDEDALTLEELEEQQRRIWAALEQAESVNSDSDVPVDTPLTGNSVASSPCPNELDLPVPEGKTSEKQTLDEPEVPEIFTKKSEAGHASSPDSEVTSLCQKEKAELAPVNTEGALLDNGSVVPNCDISNGGSQKLFPADTSPSTATKIHSPIPDMSKFATGITPFEFENMAESTGMYLRIRSLLKNSPRNQQKNKKASE

SEQ ID NO: 762992 - protein, 500 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKIFSHIVSLEGQEIQVKAKRPKPHCFNCGSEEHQMKDCPMPRNAARISEKRKEYMDACGEANNQNFQQRYHAEEVEERFGRFKPGVISEELQDALGVTDKSLPPFIYRMRQLGYPPGWLKEAELENSGLALYDGKDGTDGETEVGEIQQNKSVTYDLSKLVNYPGFNISTPRGIPDEWRIFGSIPMQACQQKDVFANYLTSNFQAPGVKSGNKRSSSHSSPGSPKKQKNESNSAGSPADMELDSDMEVPHGSQSSESFQFQPPLPPDTPPLPRGTPPPVFTPPCAPGATNKNPTEN

SEQ ID NO: 762993 - protein, 212 aa, Homo sapiens
MAAEVYFGDLELFEPFDHPEESIPKPVHTRFKDDDGDEEDENGVGDAELRERLRQCEETIEQLRAENQELKRKLNILTRPSGILVNDTKLDGPILQILFMNNAISKQYHQEIEEFVSNLVKRFEEQQKNDVEKTSFNLLPQPSSIVLEEDHKVEESCAIKNNKEAFSVVGSVLYFTNFCLDKLGQPLLNENPQLSEGWEIPSTIKSSATLFL

SEQ ID NO: 762994 - protein, 128 aa, Homo sapiens
RAEEFGTSEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 762995 - protein, 76 aa, Homo sapiens
TICLPVDKQCKTVTEDSVYLGAAVCCKRGGGGIGRQALEPLPQGIQESLNNSSPGDLEEVVKMEPEDATEEISGFL

SEQ ID NO: 762996 - protein, 751 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 762997 - protein, 822 aa, Homo sapiens
MYTPRVRGVVATRGLAREVVDRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 762998 - protein, 754 aa, Homo sapiens
MVEAGVNRPRFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 762999 - protein, 468 aa, Homo sapiens
MNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763000 - protein, 765 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTGVGDRCVSFEVFTCANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763001 - protein, 460 aa, Homo sapiens
EANIRLGTRLGVAGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763002 - protein, 751 aa, Homo sapiens; identical to SEQ ID NO: 762996

SEQ ID NO: 763003 - protein, 387 aa, Homo sapiens
SWTWQCAALERNCLTPALLPGSFLPFSGEHLADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763004 - protein, 306 aa, Homo sapiens
MVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763005 - protein, 226 aa, Homo sapiens
APYPDTWRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763006 - protein, 102 aa, Homo sapiens
SAFVPLVPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763007 - protein, 727 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGVSKQLFPWGFRGSCQDGT

SEQ ID NO: 763008 - protein, 519 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSHGSQ

SEQ ID NO: 763009 - protein, 271 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKNQRGVRA

SEQ ID NO: 763010 - protein, 245 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNTF

SEQ ID NO: 763011 - protein, 133 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHGE

SEQ ID NO: 763012 - protein, 751 aa, Homo sapiens; identical to SEQ ID NO: 762996

SEQ ID NO: 763013 - protein, 819 aa, Homo sapiens
GYCRGWVAPQVLGLGPLSRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763014 - protein, 357 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKVQPSSSKSVGGRRSLKVLREYQGLP

SEQ ID NO: 763015 - protein, 760 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLIFLVFVFSQKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763016 - protein, 654 aa, Homo sapiens
ANVVIPAADEQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763017 - protein, 598 aa, Homo sapiens
GSKHTARYEAGCRLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763018 - protein, 751 aa, Homo sapiens; identical to SEQ ID NO: 762996

SEQ ID NO: 763019 - protein, 399 aa, Homo sapiens
LFCAESCTAAYSLLGSPHNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763020 - protein, 307 aa, Homo sapiens
ECVPGVYFIPRPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763021 - protein, 213 aa, Homo sapiens
FRHRLAHELQYPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEGRQALEPLPQGIQESLNNSSPGDLEEVVKMEPEDATEEISGFL

SEQ ID NO: 763022 - protein, 91 aa, Homo sapiens
VHKHCMAMQGQTASRIPSLSSLPRVDKQCQEGLSENSAYRWTVVKTEEGRQALEPLPQGIQESLNNSSPGDLEEVVKMEPEDATEEISGFL

SEQ ID NO: 763023 - protein, 750 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPATVDKQCQEGLSENSAYRWTVVKTEEATRPQIIRMVISRSSAYSRSHNYCASPAEDADTRDDRHCYYD

SEQ ID NO: 763024 - protein, 452 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSYPTQPLSP

SEQ ID NO: 763025 - protein, 195 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTG

SEQ ID NO: 763026 - protein, 136 aa, Homo sapiens
MYEARVVNRPRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 763027 - protein, 88 aa, Homo sapiens
PRVADAWVDPRVAAPPSSLNVVPSPPSKGNIPYPLVSEIVLSNSPKCWLPPAKHWGRHPAWHWLMGTSVGSISQSSAKGPAVPLPGGP

SEQ ID NO: 763028 - protein, 83 aa, Homo sapiens
MQATSPPSSLNVVPSPPSKGNIPYPLVSEIVLSNSPKCWLPPAKHWGRHPAWHWLMGTSVGSISQSSAKASGGIRLPEVKAPG

SEQ ID NO: 763029 - protein, 136 aa, Homo sapiens; identical to SEQ ID NO: 763026

SEQ ID NO: 763030 - protein, 136 aa, Homo sapiens; identical to SEQ ID NO: 763026

SEQ ID NO: 763031 - protein, 209 aa, Homo sapiens
CQTLSRACPATQAPPQSHTELQIREGPKRTIRAAAEGAPCVGRVRCAPGNRGGREGASGVRGGVAQVPPRLPAPPIGPERDDLAGGAGRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGVWAGGRGGGGSVGRGL

SEQ ID NO: 763032 - protein, 210 aa, Homo sapiens
CQTLSRACPATQAPPQSHTELQIREGPKRTIRAAAEGAPCVGRVRCAPGNRGGREGASGVRGGVAQVPPRLPAPPIGPERDDLAGGAGRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGVWAGGRGGGGSSVGRGL

SEQ ID NO: 763033 - protein, 214 aa, Homo sapiens
CQTLSRACPATQAPPQSHTELQIREGPKRTIRAAAEGAPCVGRVRCAPGNRGGREGASGVRGGVAQVPPRLPAPPIGPERDDLAGGAGRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 763034 - protein, 214 aa, Homo sapiens; identical to SEQ ID NO: 763033

SEQ ID NO: 763035 - protein, 136 aa, Homo sapiens; identical to SEQ ID NO: 763026

SEQ ID NO: 763036 - protein, 133 aa, Homo sapiens
AAATAALCPPARLSTPSMSGLRVYSTSVTGSREVSARPDWRWGKAQGCIPVLWTLAPGTHPQDGGGVGGVRRRGAGHGLPDPVPRPHPECLHRASWVLCSRGMNFPCPSPINPTPILCTPTTGLTLTTTAACP

SEQ ID NO: 763037 - protein, 111 aa, Homo sapiens
PDFNGSTRLGLPMCWDYRRESPCLAQRLLINKGRSHSLRLKSPLFPRQPDIFRMGSLTNLPNVELYVTTQHGPHSSRLTTWHPVNLNPGNDSLRSHGKWPQRGLSSISEAG

SEQ ID NO: 763038 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 763039 - protein, 314 aa, Homo sapiens
MIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 763040 - protein, 273 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPGNVI

SEQ ID NO: 763041 - protein, 383 aa, Homo sapiens
PSPACIPGTDPREEASGGGCGPRRGGGWSSAVGSFARASGPRAHTGRRLGARPLSSLSPPLPGFCVGASELQGGCAGGGGGGPGVRGTPFTRARAHGAGARTHGRTHTHARTHTRTELARLERTNVDVLFVWSPQGGLGPRFGPGEMAQPILGHGSLQPASAAGLASLELDSSLDQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 763042 - protein, 383 aa, Homo sapiens; identical to SEQ ID NO: 763041

SEQ ID NO: 763043 - protein, 145 aa, Homo sapiens
HFIFIVLQNHVFSSLFMFPFLTPPLGFCIFQVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLAC

SEQ ID NO: 763044 - protein, 161 aa, Homo sapiens
MMPTQEALLAVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 763045 - protein, 284 aa, Homo sapiens
VASIFRCSNVRLYFLCVGCRVIGGGLRAHVLRILRGENERIPHSLGHRDPDYALRHRDLVRLVGCPCKSRSSFYLEQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 763046 - protein, 98 aa, Homo sapiens
VPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 763047 - protein, 72 aa, Homo sapiens
HLFVQVSTLPLLPARWSLTHCSDDKIDRSQEGTRLIPGGSMMLYEDSPNSPSLSSSRRAKAESWSKHSTGSS

SEQ ID NO: 763048 - protein, 127 aa, Homo sapiens
MPEVSSKGATISKKGFKKAVVKTQKKEGKKRKRTRKESYSIYIYKVLKQVHPDTGISSKAMSIMNSFVTDIFERIASEASRLAHYSKRSTISSREIQTAVRLLLPGELAKHAVSEGTKAVTKYTSSK

SEQ ID NO: 763049 - protein, 88 aa, Homo sapiens
RYSFREVLQFPVGGVNGLLSKGNDAERVGGCTLAYLPAVLEYLASDTLELAGNAVRNKKKTRIIPRHLQLAIRNDKELDKLLARVTMA

SEQ ID NO: 763050 - protein, 88 aa, Homo sapiens; identical to SEQ ID NO: 763049

SEQ ID NO: 763051 - protein, 194 aa, Homo sapiens
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPFPHF

SEQ ID NO: 763052 - protein, 325 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPLTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGI

SEQ ID NO: 763053 - protein, 377 aa, Homo sapiens [sequence omitted]

SEQ ID NO: 763054 - protein, 220 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPLTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGL

SEQ ID NO: 763055 - protein, 230 aa, Homo sapiens
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGI

SEQ ID NO: 763056 - protein, 342 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPLTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGI

SEQ ID NO: 763057 - protein, 247 aa, Homo sapiens
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGI

SEQ ID NO: 763058 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 763059 - protein, 365 aa, Homo sapiens [sequence omitted]

SEQ ID NO: 763060 - protein, 173 aa, Homo sapiens
MPLQPSCCPRPKPKLVPVITALPSWQGQLRVMLVEMPDAACPVRTAGGAVGGVVGWRGCGKGAADHGERGHFHWVLVVRVLGTRGHRADSCPLSAGHSAGRGDRFRALTWGTGTPSQGMSGQLCASEAFALALRVSSCPKHFRRLQGSIPNIPNNWNCLHMTYILDGLSINMC

SEQ ID NO: 763061 - protein, 364 aa, Homo sapiens
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWLVVCKPFGNVRFDAKLAIVGIAFSWIWSAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 763062 - protein, 123 aa, Homo sapiens
DGSFSISLICIFPTHQVVIGTGGREILGRRGWVPSNHPTLKPGTVAHCESMHSCFPARMFPFPKPPMACPTAPSCAHRNPRFHTAEKRREEKRREEKRRGEAVRCQRLWLDIEEKQLDFRGIA

SEQ ID NO: 763063 - protein, 106 aa, Homo sapiens
SVRFVLWSVSERLVETAEASRPRLSSAFIIVMLLASLNSCCNPWIYMLFTGHLFHELVQRFLCCSASYLKGRRLGETSASKKSNSSSFVLSHRSSSQRSCSQPSTA

SEQ ID NO: 763064 - protein, 389 aa, Homo sapiens [sequence omitted]

SEQ ID NO: 763065 - protein, 34 aa, Homo sapiens
MLLASLNSCCNPWIYMLFTGHLFHELVQRFLCCS

SEQ ID NO: 763066 - protein, 365 aa, Homo sapiens
ASRTGGRAFPQFPCPQHTPCALRPLVLGHWGHLDAARACGGGRSPGGLFPGVGLGATGARPRAWHCNLRVSALRVCGRSRGPWLSAGPRVQVGPRQQSRVWQMQGGPLLRRSLESVSSGRTFDGILMCLLCLIFSKTLTPTQASVIAADQKPEHFGSRQLRRGMRLRDRTRFCLGILKIKSFEKSNSWSWKLSPYEEMSGVRPPIMNGPLHPRPLVALLDGRDCTVEMPILKDVATVAFCDAQSTQEIHEKVPPRGRLGLAEPHVGGSWRDGSTAGPGHSRSGCHWGRSSLCPSRPAPSGGGHGVFPGHHQEVDIGFALSPIRRWTRGFPCAPSGGGHHVCPEPHQEVDIRFALCPIRRWTRGFP

SEQ ID NO: 763067 - protein, 109 aa, Homo sapiens
PSENHPHDCILPSASLLTWLLSLLVSSSRFKAAALASVGQVPVGAEAGHQLHAGHWPSPAWYPGRSAQGRSGHVPEPCALCCFVLPAAPFLAQNRLLPCYPCTSTEDKP

SEQ ID NO: 763068 - protein, 273 aa, Homo sapiens
GLRLGADGGGSRELGSGEAGSAGLSRGAAAAAAPGMAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 763069 - protein, 133 aa, Homo sapiens
RLRPGRRRGHGTPEGFSSDEVVGPREEFGDSPKFGLLENRCFSTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 763070 - protein, 187 aa, Homo sapiens
GGRDRAEPRGSSEEKSEGYADPGEGLRSGQMESGFALGFLLSEPLPLPHSLRREGYTVQVNVNDYLDIYCPHYNSSGVGPGAGPGPGGGAEQYVLYMVSRNGYRTCNPHQVLGEVPALQRLLSGLRVPRRPRVLLHLHAHSQPALEVSEDEGVRLLRLHIALRGEAGPHSPPVHHGPQCEDQRAGRL

SEQ ID NO: 763071 - protein, 273 aa, Homo sapiens; identical to SEQ ID NO: 763068

SEQ ID NO: 763072 - protein, 245 aa, Homo sapiens
GGRDRAEPRGSSEEKSEGYADPGEGLRSGQMESGFALGFLLSEPLPLPHSLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 763073 - protein, 70 aa, Homo sapiens
SALIAIDVEYQGVDKNPFPSLEFSRIRRIPQSLYDIIAQHLVYQRHTRVNLGVISRDCFKEQSYIQGRKL

SEQ ID NO: 763074 - protein, 264 aa, Homo sapiens
YCEEPAQGGRGGVSRVPLAAGVCRSPSPQERGLLRSHLPVFTRQRARRPPRTPGSAQERPLRLAKETEPLTMVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLVKKKLYSLIGTTVIEGS

SEQ ID NO: 763075 - protein, 193 aa, Homo sapiens
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLVKKKLYSLIGTTVIEGS

SEQ ID NO: 763076 - protein, 160 aa, Homo sapiens
TRVTSGGSRDAVPGAEPPKMAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSSRAFDNMVTSMMIQVC

SEQ ID NO: 763077 - protein, 160 aa, Homo sapiens; identical to SEQ ID NO: 763076

SEQ ID NO: 763078 - protein, 160 aa, Homo sapiens; identical to SEQ ID NO: 763076

SEQ ID NO: 763079 - protein, 160 aa, Homo sapiens; identical to SEQ ID NO: 763076

SEQ ID NO: 763080 - protein, 160 aa, Homo sapiens; identical to SEQ ID NO: 763076

SEQ ID NO: 763081 - protein, 160 aa, Homo sapiens; identical to SEQ ID NO: 763076

SEQ ID NO: 763082 - protein, 110 aa, Homo sapiens
MGISCDSRLPHFSKVRAHRGPSTGSPCVTSAFPNQLCRYGYVTNSKVKFVMVVDSSNTALRDNEIRSMFRKLHNSYTDVMCNPFYNPGDRIQSSSRAFDNMVTSMMIQVC

SEQ ID NO: 763083 - protein, 158 aa, Homo sapiens
TRVTSGGSRDAVPGAEPPKMAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSSGSVSLSTGPLITW

SEQ ID NO: 763084 - protein, 141 aa, Homo sapiens
MVHTSLDVVDEKISAMGKALVDQRELYLGLLYPTEDYKVLPHFSKVRAHRGPSTGSPCVTSAFPNQLCRYGYVTNSKVKFVMVVDSSNTALRDNEIRSMFRKLHNSYTDVMCNPFYNPGDRIQSSSRAFDNMVTSMMIQVC

SEQ ID NO: 763085 - protein, 84 aa, Homo sapiens
NIRVHPTEDYKVYGYVTNSKVKFVMVVDSSNTALRDNEIRSMFRKLHNSYTDVMCNPFYNPGDRIQSSSRAFDNMVTSMMIQVC

SEQ ID NO: 763086 - protein, 88 aa, Homo sapiens
TRVTSGGSRDAVPGAEPPKMAVCIAVIAKENYPLYIRSTPTENELKFHYMVHTSLDVVDEKISAMGKALVDQRELYLGLLYPTEDYKV

SEQ ID NO: 763087 - protein, 110 aa, Homo sapiens; identical to SEQ ID NO: 763082

SEQ ID NO: 763088 - protein, 160 aa, Homo sapiens; identical to SEQ ID NO: 763076

SEQ ID NO: 763089 - protein, 99 aa, Homo sapiens
TRVTSGGSRDAVPGAEPPKMAVCIAVIAKENYPLYIRSTPTENELKFHYMVHTSLDVVDEKISAMGKALVDQRELYLGLLYPTEDYKVCSGSYTTPTQT

SEQ ID NO: 763090 - protein, 160 aa, Homo sapiens; identical to SEQ ID NO: 763076

SEQ ID NO: 763091 - protein, 111 aa, Homo sapiens
MVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSSRAFDNMVTSMMIQVC

SEQ ID NO: 763092 - protein, 88 aa, Homo sapiens; identical to SEQ ID NO: 763086

SEQ ID NO: 763093 - protein, 110 aa, Homo sapiens; identical to SEQ ID NO: 763082

SEQ ID NO: 763094 - protein, 108 aa, Homo sapiens
TRVTSGGSRDAVPGAEPPKMAVCIAVIAKENYPLYIRSTPTENELKFHYMVHTSLDVVDEKISAMGKALVDQRELYLGLLYPTEDYKVVSFRAGCVSGRTYSCKMYFR

SEQ ID NO: 763095 - protein, 738 aa, Homo sapiens
TAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 763096 - protein, 490 aa, Homo sapiens
MDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 763097 - protein, 490 aa, Homo sapiens; identical to SEQ ID NO: 763096

SEQ ID NO: 763098 - protein, 490 aa, Homo sapiens; identical to SEQ ID NO: 763096

SEQ ID NO: 763099 - protein, 106 aa, Homo sapiens
MLVEAWVNRQRVVQSGTVLCTGEKMVMEGNKDSEEHHQASGPRGPTPQPTRRGTGPPQSHTTGCQSGPARSLHSSEPSLLKNSDLMELWVLHPKFPRHFWPKEGRN

SEQ ID NO: 763100 - protein, 270 aa, Homo sapiens
MDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKDPKRAKTP

SEQ ID NO: 763101 - protein, 150 aa, Homo sapiens
MEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEM

SEQ ID NO: 763102 - protein, 148 aa, Homo sapiens
MVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPR

SEQ ID NO: 763103 - protein, 122 aa, Homo sapiens
PLPLPALRQSRSKMAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 763104 - protein, 117 aa, Homo sapiens
MARVRGLGCRVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 763105 - protein, 114 aa, Homo sapiens
RLECSGMISAHCNFPARGKRFLCLSHPGSWDYRCAPPCPARMWKTLTFFVALPGVAVSMLNVYLKSHHGEHERPEFIAYPHLRIRTKPFPWGDGNHTLFHNPHVNPLPTGYEDE

SEQ ID NO: 763106 - protein, 122 aa, Homo sapiens; identical to SEQ ID NO: 763103

SEQ ID NO: 763107 - protein, 122 aa, Homo sapiens; identical to SEQ ID NO: 763103

SEQ ID NO: 763108 - protein, 122 aa, Homo sapiens; identical to SEQ ID NO: 763103

SEQ ID NO: 763109 - protein, 355 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 763110 - protein, 355 aa, Homo sapiens; identical to SEQ ID NO: 763109

SEQ ID NO: 763111 - protein, 355 aa, Homo sapiens; identical to SEQ ID NO: 763109

SEQ ID NO: 763112 - protein, 284 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALT

SEQ ID NO: 763113 - protein, 355 aa, Homo sapiens; identical to SEQ ID NO: 763109

SEQ ID NO: 763114 - protein, 304 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKIPQGERGLEPGW

SEQ ID NO: 763115 - protein, 132 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGNPKGEGSRI

SEQ ID NO: 763116 - protein, 140 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGLMGTIKSKVSGGKRAWP

SEQ ID NO: 763117 - protein, 136 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGLIFNKYTLNQGRN

SEQ ID NO: 763118 - protein, 138 aa, Homo sapiens
CRRCLEFTLPRIELMPRATLTPSTCSFLSSFSGIRAPNFPNQNGGSYARFHFLTNPNSYRIPLGPFPEYLSCSFRGVCHCCGLRLLTESWISEASGRFPLPAVSFQCTLHNAPTAIIQIQPHHCPHHLRTWAWSFWWG

SEQ ID NO: 763119 - protein, 323 aa, Homo sapiens
PGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIDEARSKKCGVLVHCLAGISRSVTVTVAYLMQKMNLSLNDAYDFVKRKKSNISPNFNFMGQLLDFERTLGLSSPCDNHASSEQLYFSTPTNHNLFPLNTLEST

SEQ ID NO: 763120 - protein, 172 aa, Homo sapiens
MRKQTRVSSALGLKCADPLHSSAVDLYSKLLPYPHWAWPGPSGVGQDQPATMLPSVPQPHLPTHVGRLLEGGTSLTHANVFQDEARSKKCGVLVHCLAGISRSVTVTVAYLMQKMNLSLNDAYDFVKRKKSNISPNFNFMGQLLDFERTLGLSSPCDNHASSEQLYFSTPTN

SEQ ID NO: 763121 - protein, 212 aa, Homo sapiens
MAQAHRTPQPRAAPSQPRVFKLVLLGSGSVGKSSLALRYVKNDFKSILPTVGCAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVAQELLQRSDEEGQALRGDAAVALNKGPARQAKCCAH

SEQ ID NO: 763122 - protein, 212 aa, Homo sapiens; identical to SEQ ID NO: 763121

SEQ ID NO: 763123 - protein, 215 aa, Homo sapiens
MAQAHRTPQPRAAPSQPRVFKLVLLGSGSVGKSSLALRYVKNDFKSILPTVGCAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVGESRPRGPDKGEVLVPDQLPWVPVAGDVVSHRMSLGTGW

SEQ ID NO: 763124 - protein, 158 aa, Homo sapiens
MAQAHRTPQPRAAPSQPRVFKLVLLGSGSVGAFFTKVVDVGATSLKLEIWDTAGQEKYHSVCHLYFRGANAALLVYDITRKDSFLKAQQWLKDLEEELHPGEVLVMLVGNKTDLSQEREVTFQDEDRVNSCRQVADGETPHTLEAGAGEDPTQGLDRR

SEQ ID NO: 763125 - protein, 212 aa, Homo sapiens; identical to SEQ ID NO: 763121

SEQ ID NO: 763126 - protein, 190 aa, Homo sapiens
MAQAHRTPQPRAAPSQPRVFKLVLLGSGSVGAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVAQELLQRSDEEGQALRGDAAVALNKGPARQAKCCAH

SEQ ID NO: 763127 - protein, 142 aa, Homo sapiens
RHLLEARGGQAPRGDAAVCSEQGAREAGQMLCPLGAATPGGCGEDTPCLGHGQLKVDSDSLSMLGCSRALDVPMEEGKEFADSQKLLFMETSAKLNHQVSEVFNTVAQELLQRSDEEGQALRGDAAVALNKGPARQAKCCAH

SEQ ID NO: 763128 - protein, 212 aa, Homo sapiens; identical to SEQ ID NO: 763121

SEQ ID NO: 763129 - protein, 202 aa, Homo sapiens
GSPEEGPRWVPSRGLPLPHVSWVLSWFFAQHQSPQVPTGMMGGEPGGGDLAFQALQEEEGRTPPARGRASSREHTPPLPGPGLLRSAKKHNLDTKRGGVRAPRLQLSRILLLEVNQVSLGNSLINSAGFCGCFLQEGKEFADSQKLLFMETSAKLNHQVSEVFNTVAQELLQRSDEEGQALRGDAAVALNKGPARQAKCCAH

SEQ ID NO: 763130 - protein, 504 aa, Homo sapiens
EAGRGRAAAQAPPRGRLQPGAPSRSSPRRAAGWWAQRRRRHWEMTLPGGPTGMARPGGARPCSPGLERAPRRSVGELRLLFEARCAAVAAAAAAGEPRARGAKRRGGQVPNGLPRAPPAPVIPQLTVTAEEPDVPPTSPGPPERERDCLPAAGSSHLQQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQGDEEVLRRYLNRLQQIRDTLEVSEFFRRHEVIGSSLLFVHDHCHRAGVWLIDFGKTTPLPDGQILDHRRPWEEGNREDGYLLGLDNLIGILASLAER

SEQ ID NO: 763131 - protein, 356 aa, Homo sapiens [sequence omitted]

SEQ ID NO: 763132 - protein, 194 aa, Homo sapiens
SLWLQSSEPPTAAAMLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 763133 - protein, 194 aa, Homo sapiens; identical to SEQ ID NO: 763132

SEQ ID NO: 763134 - protein, 270 aa, Homo sapiens
SLWLQSSEPPTAAAMLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRFYGVSLCHQAGVQWHNLSSLQPRPPGFKRFSCLNPPSCWNHRRVPPCPANFCIFNRNGVSPCWPRWSQSLDLMIPPL

SEQ ID NO: 763135 - protein, 143 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINSRVLVEDDEIMQGFIRAFRPLPRHLWYLLDLKQMEEPCRF

SEQ ID NO: 763136 - protein, 194 aa, Homo sapiens; identical to SEQ ID NO: 763132

SEQ ID NO: 763137 - protein, 194 aa, Homo sapiens; identical to SEQ ID NO: 763132

SEQ ID NO: 763138 - protein, 270 aa, Homo sapiens; identical to SEQ ID NO: 763134

SEQ ID NO: 763139 - protein, 482 aa, Homo sapiens
MKGWGPHQRGLVSAMSLSGQNMLRLSLHPHLHKGPSPVLPGISKVFCFPSVLMASSAKSAEMPTISKTLNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 763140 - protein, 430 aa, Homo sapiens
MASSAKSAEMPTISKTLNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 763141 - protein, 418 aa, Homo sapiens [sequence omitted]

SEQ ID NO: 763142 - protein, 400 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763143 - protein, 229 aa, Homo sapiens [sequence omitted]

SEQ ID NO: 763144 - protein, 229 aa, Homo sapiens [sequence omitted]

SEQ ID NO: 763145 - protein, 379 aa, Homo sapiens
MNRGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763146 - protein, 283 aa, Homo sapiens
MGEKHCRPGVQDQPGQHTYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763147 - protein, 434 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLVAAGVGLSPVIPVLKRLMGEKHCRPGVQDQPGQHTYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763148 - protein, 460 aa, Homo sapiens
MASEKPLAAVTCTAPVNIAVIKYWGKRDEELVLPINSSLSVTLHQDQLKTTTTAVISKDFTEDRIWLNGREEDVGQPRLQACLRESELGSPSAHPSLLSAGSEHPESASASVPLLRQQAGWLGTRHARWAASSRAVAHLNDQLGLVRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763149 - protein, 283 aa, Homo sapiens
LGEAGVNRQRVKTAWAHTYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763150 - protein, 351 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQNMEVTDA

SEQ ID NO: 763151 - protein, 207 aa, Homo sapiens
MELGSVGLVGAPTSLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763152 - protein, 217 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSGVGRVEQQPGGLCP

SEQ ID NO: 763153 - protein, 102 aa, Homo sapiens
MTPAPTSWVLTACRSQLPDCLSRDRMPLGEGVASPELGSGCGGLAGLLGHVGGGLTPGPWAACCGAVQGVLRPPRCQERSPPSASAALSCTSALPRWDGEGV

SEQ ID NO: 763154 - protein, 290 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTLRPGPVMHCFELPAFLFMLSGLFPGRSPHGPRGS

SEQ ID NO: 763155 - protein, 439 aa, Homo sapiens
MASEKPLAAVTCTAPVNIAVIKYYCHCDTQAGVQWRDLGSLQPPLPGFNRFSCLSLSSSWDYRGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763156 - protein, 229 aa, Homo sapiens [sequence omitted]

SEQ ID NO: 763157 - protein, 229 aa, Homo sapiens [sequence omitted]

SEQ ID NO: 763158 - protein, 486 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLGTFCCPCRGPQALQAVNRECPRVELAEVGDRRLGRRMLASKADGPEALSSGNPHLPWGVGRSWGGELSGSTAQAALRTLPEIRMPAAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 763159 - protein, 451 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQGLNLGDLGPPGPELEAVLMLKDDAWEGGPGWGCGCGRTLVVRLVLGGSVRNRSALSALRGTRLRSVFVCYG

SEQ ID NO: 763160 - protein, 284 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLRKPPSASDGGCPRRFC

SEQ ID NO: 763161 - protein, 102 aa, Homo sapiens; identical to SEQ ID NO: 763153

SEQ ID NO: 763162 - protein, 104 aa, Homo sapiens
MASEKPLAAVTCTAPVNIAVIKYWPRQTGKLRLREGRGGGRAGPRAPSRDKLGATRSPATAAAPAGSPGACPLAITELSKSSIIDSHESSRHHDWLIFLCFPYQ

SEQ ID NO: 763163 - protein, 186 aa, Homo sapiens
MRALDPPRERTGPPRERGLSHARGRMTVPDLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 763164 - protein, 122 aa, Homo sapiens
PVVLQWGSALLGFSTHQCGSRVSCCYERDWRGEAETYEGPGFFQDMGFHLPSPHSELLVSEDCLDWTYLPALFDQSLLGSLSLGQKLEVSPHFHCSPSRLLWTGSALGRTELPWARQVGGWG

SEQ ID NO: 763165 - protein, 328 aa, Homo sapiens
HWSSPVVLQWGSALLGFSTHQCGSRVSCCYERDWRGLSLELPVPQQEAMELGHGAGTTTFTRAHLNDKEGQQDLDPWKAAYSSLDTSKFKNQGLSSPQPLPLGSSTQGSSLGQCHLKEIPPPPPTAASRDSLGMDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 763166 - protein, 144 aa, Homo sapiens
MTRRANRTWTPGKRPTVPWTPPSSRTRAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 763167 - protein, 132 aa, Homo sapiens
MGAATAPGSRGAAPSGPAILEGLFCRFFPLRKCRSRRWPMSCDFCLFPFLLGLSQTRKGPVRNVLHNLSGKAANVALLRLPCSLPLGRPPCFLNTKWRHVVSIRRQREIGVGPKALECTPLPPRGLPPPRVL

SEQ ID NO: 763168 - protein, 132 aa, Homo sapiens; identical to SEQ ID NO: 763167

SEQ ID NO: 763169 - protein, 132 aa, Homo sapiens; identical to SEQ ID NO: 763167

SEQ ID NO: 763170 - protein, 132 aa, Homo sapiens; identical to SEQ ID NO: 763167

SEQ ID NO: 763171 - protein, 132 aa, Homo sapiens; identical to SEQ ID NO: 763167

SEQ ID NO: 763172 - protein, 79 aa, Homo sapiens
SGGEGRRGEACGAGARGRARGALSSPASGRPAWIPHPSSCSPAAAEEDKHKDEVLNSRSHNVGDGPPDFLTDLHYLVDT

SEQ ID NO: 763173 - protein, 132 aa, Homo sapiens; identical to SEQ ID NO: 763167

SEQ ID NO: 763174 - protein, 132 aa, Homo sapiens; identical to SEQ ID NO: 763167

SEQ ID NO: 763175 - protein, 124 aa, Homo sapiens
SAQGEAAERKTNIKMKCLIQGHTMSGMDLQISLLKTSSGLPLIVHYETESCYVAQAGLELLTSSDPPVLASQVSGLRACAITPNLIHCLYKFFFLYSKNQKKQNWIHVQNMQVRRGLVTQWLRM

SEQ ID NO: 763176 - protein, 132 aa, Homo sapiens; identical to SEQ ID NO: 763167

SEQ ID NO: 763177 - protein, 132 aa, Homo sapiens; identical to SEQ ID NO: 763167

SEQ ID NO: 763178 - protein, 132 aa, Homo sapiens; identical to SEQ ID NO: 763167

SEQ ID NO: 763179 - protein, 138 aa, Homo sapiens
MGAATAPGSRGAAPSGPAILEGLFCRFFPLRKCRSRRWPMSCDFCLFPFLLGLSQTRKGPVRNVLHNLSGKAANVALLRLPCSLPLGRPPCFLNTKWRHVRKTNIKMKCLIQGHTMSGMDLQISLLVRRGLVTQWLRM

SEQ ID NO: 763180 - protein, 132 aa, Homo sapiens; identical to SEQ ID NO: 763167

SEQ ID NO: 763181 - protein, 132 aa, Homo sapiens; identical to SEQ ID NO: 763167

SEQ ID NO: 763182 - protein, 132 aa, Homo sapiens; identical to SEQ ID NO: 763167

SEQ ID NO: 763183 - protein, 115 aa, Homo sapiens
SGGEGRRGEACGAGARGRARGALSSPASGRPAWIPHPSSCSPAAAGGQKDRNPLTAACRIAALLFVGRARNVVLKRMASIYIMLCLRFASFFRLKPQKPHLLPLCRFHRGTLFRH

SEQ ID NO: 763184 - protein, 424 aa, Homo sapiens
CDKCRKAFIHRSSLTKHEKTHKGEGAFPNGTDQGIYPGKKHHECTDCGKTFLWKTQLTEHQRIHTGEKPFECNVCGKAFRHSSSLGQHENAHTGEKPYQCSLCGKAFQRSSSLVQHQRIHTGEKPYRCNLCGRSFRHGTSLTQHEVTHSGEKPFQCKECGKAFSRCSSLVQHERTHTGEKPFECSICGRAFGQSPSLYKHMRIHKRGKPYQSSNYSIDFKHSTSLTQDESTLTEVKSYHCNDCGEDFSHITDFTDHQRIHTAENPYDCEQAFSQQAISHPGEKPYQCNVCGKAFKRSTSFIEHHRIHTGEKPYECNECGEAFSRRSSLTQHERTHTGEKPYECIDCGKAFSQSSSLIQHERTHTGEKPYECNECGRAFRKKTNLHDHQRIHTGEKPYSCKECGKNFSRSSALTKHQRIHTRNKL

SEQ ID NO: 763185 - protein, 424 aa, Homo sapiens; identical to SEQ ID NO: 763184

SEQ ID NO: 763186 - protein, 424 aa, Homo sapiens; identical to SEQ ID NO: 763184

SEQ ID NO: 763187 - protein, 737 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 763188 - protein, 672 aa, Homo sapiens
MKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 763189 - protein, 672 aa, Homo sapiens; identical to SEQ ID NO: 763188

SEQ ID NO: 763190 - protein, 650 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 763191 - protein, 586 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKL

SEQ ID NO: 763192 - protein, 130 aa, Homo sapiens
ISHIGRMCLLKGNMVFALMFLQLSQKGYRQSGMIPTGYSQCQPNYLKLKNIMMETHLLIPDRGVAGQVVDQAGQAGQVVDLAAGQVDRVDKEVAQEVDKMVEDEVGIEIDQEVGATNGVLTEYLIVNLPV

SEQ ID NO: 763193 - protein, 154 aa, Homo sapiens
MLISACFLYGDWPGFYSSNQSLQNKGGPVDISHTHWLRGCGAMEGLKPRVSGIIFPRRAVRVPEVTHGQGRAAALPPLPFTLSLPVGGCGHCARREAAVASNAWETPLGGHYGAGSTLGGVREPEEGEAKGALSMGRASFWAAPAWAGRGTVCP

SEQ ID NO: 763194 - protein, 643 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 763195 - protein, 723 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRQSRQGSRSGSRQDGRRRSGNRNRSRSGGHKRSFD

SEQ ID NO: 763196 - protein, 504 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYSLRGVAGPLEPH

SEQ ID NO: 763197 - protein, 92 aa, Homo sapiens
SSPLEVLESAACEKLPTPTPQVVKEGDSFPDTLAKNGQEIAPAQISKSLMVDNYTKDGVPGQERPKGPSAVVPSTSTGGVALPITTAIETVN

SEQ ID NO: 763198 - protein, 151 aa, Homo sapiens
EEALQQAKEDLARLLRDYQELMNVKLALDVEIATYRKLLEGEECRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKH

SEQ ID NO: 763199 - protein, 125 aa, Homo sapiens
MHTEPKCSTTTCFFSLPYRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKH

SEQ ID NO: 763200 - protein, 113 aa, Homo sapiens
MPPMPSLMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKH

SEQ ID NO: 763201 - protein, 952 aa, Homo sapiens
LSDRCVLATVGRVAAVCALAISFSERGESNSHLQLSKELFLRALQRGSFSFRSAVSAQVRTMAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 763202 - protein, 931 aa, Homo sapiens
LSDRCVLATVGRVAAVCALAISFSERGESNSHLQLSKELFLRALQRGSFSFRSAVSAQVRTMAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNPSLYCSLLFSVFQSQPLTDYFQPLHMLIPSTKNAFPLILITTHPTCHFLRKALTEPPSEGPG

SEQ ID NO: 763203 - protein, 907 aa, Homo sapiens
LSDRCVLATVGRVAAVCALAISFSERGESNSHLQLSKELFLRALQRGSFSFRSAVSAQVRTMAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVVS

SEQ ID NO: 763204 - protein, 73 aa, Homo sapiens
CRIRRARHEESRVEEGYKSLKIQHSKGPVLPRVPNCGKWTKMADGPFKNIHFLQRQGFTLKKDWLKALVSRKG

SEQ ID NO: 763205 - protein, 113 aa, Homo sapiens
LGQFSMAKVTSEPQKPNEDVDEQTPSTSSTKGRKKGKTPRQRRSRSGVKGLKTTRKAKRPLRGSSSQKAGETNTPAGKPKKARGPILRGRYHRLKEKMKKEEADKEQSETSVL

SEQ ID NO: 763206 - protein, 843 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRSAPAARAAAYDRHWLPRGPHQASGRQLRPPHRPRLTPPRRREDRRDACLPATAPASPHPTTPATLHITPLEGRTGRVEPRGGTLRPGPTAPSPACRPSPPAWTARRREGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 763207 - protein, 871 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQTHWSEFSGNPYSHPQYTAYNEAWRFSNPALLSSPYYYSAAPRSAPAARAAAYDRHWLPRGPHQASGRQLRPPHRPRLTPPRRREDRRDACLPATAPASPHPTTPATLHITPLEGRTGRVEPRGGTLRPGPTAPSPACRPSPPAWTARRREGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 763208 - protein, 866 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRSAPAARAAAYDRHWLPRGPHQASGRQLRPPHRPRLTPPRRREDRRDACLPATAPASPHPTTPATLHITPLEGRTGRVEPRGGTLRPGPTAPSPACRPSPPAWTARRREGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 763209 - protein, 491 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRSAPAARAAAYDRH

SEQ ID NO: 763210 - protein, 837 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLMPPPGPPLPLVPLPMTATSYRGDHIKLQADSFGLHIVPVLTPPRRREDRRDACLPATAPASPHPTTPATLHITPLEGRTGRVEPRGGTLRPGPTAPSPACRPSPPAWTARRREGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 763211 - protein, 860 aa, Homo sapiens
MRPQCTPAHRPGAILLTAQPRAPTVASCGYCSCKLRPTRRSPTGKAVVRPPPPGAPQQPGVHSSSLPHRPSLFSSSPEVEFERRHGGGAALLPLLCLPMDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLMPPPGPPLPLVPLPMTATSYRGDHIKLQADSFGLHIVPVLTPPRRREDRRDACLPATAPASPHPTTPATLHITPLEGRTGRVEPRGGTLRPGPTAPSPACRPSPPAWTARRREGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 763212 - protein, 33 aa, Homo sapiens
MLAELAGNPPSGIYWKSIFLGPKESCLWEVSCW

SEQ ID NO: 763213 - protein, 219 aa, Homo sapiens
RPVTCRGRQHRALEMKTLFLGVTLGLAAALSFTLEEEDITGTWYVKAMVVDKDFPEDRRPRKVSPVKVTALGGGKLEATFTFMREDRCIQKKILMRKTEEPGKYSACLSAVEMDQITPALWEALAIDTLRKLRIGTRRPRIDGGRKLMYLQELPRRDHYIFYCKDQHHGGLLHMGKLVGRNSDTNREALEEFKKLVQRKGLSEEDIFTPLQTGSCVPEH

SEQ ID NO: 763214 - protein, 102 aa, Homo sapiens
MREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 763215 - protein, 184 aa, Homo sapiens
RPVTCRGRQHRALEMKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 763216 - protein, 146 aa, Homo sapiens [sequence omitted]

SEQ ID NO: 763217 - protein, 170 aa, Homo sapiens
PKRDVTLFLNLHQEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 763218 - protein, 151 aa, Homo sapiens
PKRDVTLFLNQHQEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGGTMKNDMHKKIKIIYYK

SEQ ID NO: 763219 - protein, 146 aa, Homo sapiens
PKRDVTLFLNLHQEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQEEMSGSATAILQL

SEQ ID NO: 763220 - protein, 103 aa, Homo sapiens
PKRDVTLFLNLHQEYDWRNYQPSQMSESELQMLASLRWQQNEELEDAGTSHGLSASQVDNCNVSISTSSDDTTTWNSCLPPPVNQGRHYQKEMNPPSPSNPRL

SEQ ID NO: 763221 - protein, 134 aa, Homo sapiens
GPRERKYSPNKADCTYSCSQSTYYASASPTIQSFMNLSGKRLHFHFHKALRFSIPLLCECGRQTRVVSAMLLVLCDGLLSIGKPAIHLHRPTLRNISTLQPCYNLVCRHLDHLFLPQDVTLLHYIDDITLIVSS

SEQ ID NO: 763222 - protein, 146 aa, Homo sapiens [sequence omitted]

SEQ ID NO: 763223 - protein, 134 aa, Homo sapiens
PKRDVTLFLNLHQEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQG

SEQ ID NO: 763224 - protein, 145 aa, Homo sapiens
PKRDVTLFLNLHQEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQDISHTPDQAVTR

SEQ ID NO: 763225 - protein, 68 aa, Homo sapiens
PHNPKPNQQTPHPPPPTHPTPQTPHPNPTPTNPTPTNTPPPPAKRNPAPTNQKERLEGKEKGGKNPGP

SEQ ID NO: 763226 - protein, 105 aa, Homo sapiens
WAPLGGACPSLLGPEPVQGTGRVQVPLWVAACLECPHWCCLWHSHCCTFLVVFKKLDEEGCHSGLGVVANFSPEREPPLATTSVSVSPPSALLQAKAWPGFCLPI

SEQ ID NO: 763227 - protein, 124 aa, Homo sapiens
MLCPLKKPMTLNKRPFQVSPTKAMTTWMIWMMKMMMTMWTARTPCDSNDSDDVDDTDDSHQSDESHHSDESDELVTDFPTDLPATEVFTPVVSPTVRHILMAEGDRCGLWTWRSNNLKKVSAET

SEQ ID NO: 763228 - protein, 124 aa, Homo sapiens; identical to SEQ ID NO: 763227

SEQ ID NO: 763229 - protein, 124 aa, Homo sapiens; identical to SEQ ID NO: 763227

SEQ ID NO: 763230 - protein, 124 aa, Homo sapiens; identical to SEQ ID NO: 763227

SEQ ID NO: 763231 - protein, 124 aa, Homo sapiens; identical to SEQ ID NO: 763227

SEQ ID NO: 763232 - protein, 124 aa, Homo sapiens; identical to SEQ ID NO: 763227

SEQ ID NO: 763233 - protein, 124 aa, Homo sapiens; identical to SEQ ID NO: 763227

SEQ ID NO: 763234 - protein, 124 aa, Homo sapiens; identical to SEQ ID NO: 763227

SEQ ID NO: 763235 - protein, 124 aa, Homo sapiens; identical to SEQ ID NO: 763227

SEQ ID NO: 763236 - protein, 124 aa, Homo sapiens; identical to SEQ ID NO: 763227

SEQ ID NO: 763237 - protein, 124 aa, Homo sapiens; identical to SEQ ID NO: 763227

SEQ ID NO: 763238 - protein, 124 aa, Homo sapiens; identical to SEQ ID NO: 763227

SEQ ID NO: 763239 - protein, 124 aa, Homo sapiens; identical to SEQ ID NO: 763227

SEQ ID NO: 763240 - protein, 199 aa, Homo sapiens
STRGILGLLVQQEEAEHSIVGTRLVSGQLQPSQPNADQGKLTTMRIAVICFCLLGITCAIPVKQADSGKVLRKSRMLCPLKKPMTLNKRPFQVSPTKAMTTWMIWMMKMMMTMWTARTPCDSNDSDDVDDTDDSHQSDESHHSDESDELVTDFPTDLPATEVFTPVVSPTGRHILMAEGDRCGLWTWRSNNLKKVSAET

SEQ ID NO: 763241 - protein, 185 aa, Homo sapiens
STRGILGLLVQQEEAEHSIVGTRLVSGQLQPSQPNADQGKLTTMRIAVICFCLLGITCAIPVKQADSGKVLRKSRPFQVSPTKAMTTWMIWMMKMMMTMWTARTPCDSNDSDDVDDTDDSHQSDESHHSDESDELVTDFPTDLPATEVFTPVVSPTVRHILMAEGDRCGLWTWRSNNLKKVSAET

SEQ ID NO: 763242 - protein, 222 aa, Homo sapiens
MTTWMIWMMKMMMTMWTARTPCDSNDSDDVDDTDDSHQSDESHHSDESDELVTDFPTDLPATEVFTPVVSPTVRHILMAEGDRCGLWTWRSRDITFTHGKRGKLNWWHYKGPSPLAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 763243 - protein, 124 aa, Homo sapiens; identical to SEQ ID NO: 763227

SEQ ID NO: 763244 - protein, 87 aa, Homo sapiens
STRGILGLLVQQEEAEHSIVGTRLVSGQLQPSQPNADQGKLTTMRIAVICFCLLGITCAIPVKQADSGKVLRKSSFTTNTQMLWPHG

SEQ ID NO: 763245 - protein, 87 aa, Homo sapiens; identical to SEQ ID NO: 763244

SEQ ID NO: 763246 - protein, 87 aa, Homo sapiens; identical to SEQ ID NO: 763244

SEQ ID NO: 763247 - protein, 218 aa, Homo sapiens
EQQDEVQYSICRDQTRLRPKLRGLLSHNGRNQGKLTTMRIAVICFAVLDSHPCVLIDHAKRLGRWLAGNVILEEQRRILHSNNSAMMRGGPPLAKTSVHPVSEAESPSPTEMLCPLKKPMTLNKRPFQVSPTKAMTTWMIWMMKMMMTMWTARTPCDSNDSDDVDDTDDSHQSDESHHSDESDELVTDFPTDLPATEVFTPVVSPKVDTRDKVEPKTR

SEQ ID NO: 763248 - protein, 124 aa, Homo sapiens; identical to SEQ ID NO: 763227

SEQ ID NO: 763249 - protein, 124 aa, Homo sapiens; identical to SEQ ID NO: 763227

SEQ ID NO: 763250 - protein, 124 aa, Homo sapiens; identical to SEQ ID NO: 763227

SEQ ID NO: 763251 - protein, 124 aa, Homo sapiens; identical to SEQ ID NO: 763227

SEQ ID NO: 763252 - protein, 124 aa, Homo sapiens; identical to SEQ ID NO: 763227

SEQ ID NO: 763253 - protein, 124 aa, Homo sapiens; identical to SEQ ID NO: 763227

SEQ ID NO: 763254 - protein, 87 aa, Homo sapiens; identical to SEQ ID NO: 763244

SEQ ID NO: 763255 - protein, 87 aa, Homo sapiens; identical to SEQ ID NO: 763244

SEQ ID NO: 763256 - protein, 207 aa, Homo sapiens
STRGILGLLVQQEEAEHSIVGTRLVSGQLQPSQPNADQGKLTTMRIAVICFCLLGITCAIPINRLILEDLRTHLRGRISKPHRMLCPLKKPMTLNKRPFQVSPTKAMTTWMIWMMKMMMTMWTARTPCDSNDSDDVDDTDDSHQSDESHHSDESDELVTDFPTDLPATEVFTPVVSPTVRHILMAEGDRCGLWTWRSNNLKKVSAET

SEQ ID NO: 763257 - protein, 151 aa, Homo sapiens
HASPTRPLTCHPVPWDATDRRDITFTHGKRGKLNWWHYKGPSPLAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 763258 - protein, 131 aa, Homo sapiens
MLCPLKKPMTLNKRPFQVSPTKAMTTWMIWMMKMMMTMWTARTPCDSNDSDDVDDTDDSHQSDESHHSDESDELVTDFPTDLPATEVFTPVVSPTVRHILMAEGDRCGLWTWRSGHNLHIESQEVDCAYKA

SEQ ID NO: 763259 - protein, 87 aa, Homo sapiens; identical to SEQ ID NO: 763244

SEQ ID NO: 763260 - protein, 87 aa, Homo sapiens; identical to SEQ ID NO: 763244

SEQ ID NO: 763261 - protein, 205 aa, Homo sapiens
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 763262 - protein, 205 aa, Homo sapiens; identical to SEQ ID NO: 763261

SEQ ID NO: 763263 - protein, 207 aa, Homo sapiens
PVGRLLTTRSLFLVAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 763264 - protein, 205 aa, Homo sapiens; identical to SEQ ID NO: 763261

SEQ ID NO: 763265 - protein, 205 aa, Homo sapiens; identical to SEQ ID NO: 763261

SEQ ID NO: 763266 - protein, 187 aa, Homo sapiens
MSRGLQLLLLSCAYSLAPATPEVKVACSEDVDLPCTAPWDPQVPYTVSWVKLLEGGEERMETPQEDHLRGQHYHQKGQTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 763267 - protein, 861 aa, Homo sapiens
MAQCLTSGNFHSHTYVLGHQHMCEYKKYDRYCNKELFTVNLFYRILNLNYFHPISKKKYCITLKDSQFEIIIQTAVASLVKYCFVSIRIVQTIVRQLHYYSCKSYCLEISEKKRKFYGEMNKMTSKLFSSATEVLWISTAQSSSVCPQLLMPQDVTPFQSLFAKVSNYVSFKSTFYTHIFQILWCTQRQDGKGLPFIDASCSMDQALPMHPCWFFYPHISHSPEALTAIAQMRKLKVSENMQSTQSHAACVCKGWNENPICVSPKSPSTIMVSISFCNQIGWDMSALKDSKKEYLSLYLNLTSMGLLFVFGGVKHYNNNLILFVQWILYYSVKRFMTSQSKLDDSNEDFFKETSMSNKVANKLNFYGVATSELKLVEIEVDIQKYCYNLHLNNTNIYYFYIFIYLWNIDVILKQYFQIILKYIKNIIHYHPIEFFKELSVSLKCEIQSTYFTIEYSVYVSIIYISKLESSKFIFVLNKMKLKFYMNFNFHFRFRRVPLQVYYMGVLCDAEIWGMNESVSACFELAPRAISPDQQRVNKLELHLNFLVEQVTKGKIVVQRQKCSVVYNEPAISLRVQVFTEIYFRKTSNPCLKINVSWVWRHTSIIPATQEAEAGGSLEFRSLRPPGQHRKIPSQFFKMRKKIDKLKHIKILKSLFKQTEIHGSGSSKLKVVGGSTGGVCKEGFYRVNIEVKYEKLFDWQKCGQLHYLNYPGGRSLITQLILSRPPVGGLSLFHFVYAGTLAMGAISAYCSPITKFYTFFLYQGKWGSSPGGFLPPCFPQQNETVPFASVGNLLNKAFLIFLSHLILSYPLLCTLFTCFWNTCVSCTHLLHYLGNPNRRPLGWIGRELLAYVSPLSLYLELS

SEQ ID NO: 763268 - protein, 72 aa, Homo sapiens
APEEAGCACGTVVRGRKITYLKRRSIPENRGRPVFCVPGCGVPGHGVEGAERRDLRASSSGDGALCDCTESA

SEQ ID NO: 763269 - protein, 384 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 763270 - protein, 306 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQEQKSRMLT

SEQ ID NO: 763271 - protein, 306 aa, Homo sapiens; identical to SEQ ID NO: 763270

SEQ ID NO: 763272 - protein, 286 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVGKALIDNV

SEQ ID NO: 763273 - protein, 302 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGKAL

SEQ ID NO: 763274 - protein, 169 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALFALGE

SEQ ID NO: 763275 - protein, 234 aa, Homo sapiens
ASELGQTTCTFPREDLWSRHKSRAGACHKKRRQLGSQLEMLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQMECLSVQCLEATHSMNFGVPYS

SEQ ID NO: 763276 - protein, 286 aa, Homo sapiens; identical to SEQ ID NO: 763272

SEQ ID NO: 763277 - protein, 158 aa, Homo sapiens
MFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 763278 - protein, 1161 aa, Homo sapiens
QLGRLGPERRGGRALTVCVEASMKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEASPTSPRSPPCCVSLKALSSQRWLRTMSTFTRRSGFTICQGWRGCLWTYHPWWTSGTTSTRSWPCTSIQTSTARVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 763279 - protein, 119 aa, Homo sapiens
MELFNDGHTKDPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 763280 - protein, 1169 aa, Homo sapiens
QLGRLGPERRGGRALTVCVEASMKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKGQGCVFWQSIRRVDEEHEQQVDMQVLVYGTRTSKDKSGAYLFLPDGEASPTSPRSPPCCVSLKALSSQRWLRTMSTFTRRSGFTICQGWRGCLWTYHPWWTSGTTSTRSWPCTSIQTSTARVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 763281 - protein, 1109 aa, Homo sapiens
QLGRLGPERRGGRALTVCVEASMKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKGQGCVFWQSIRRVDEEHEQQVDMQVLVYGTRTSKDKSGAYLFLPDGEASPTSPRSPPCCVSLKALSSQRWLRTMSTFTRRSGFTICQGWRGCLWTYHPWWTSGTTSTRSWPCTSIQTSTASGIFFTDLNGFQVQPRRYLKKLPLQANFYPMPVMAYIQAHSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 763282 - protein, 1109 aa, Homo sapiens; identical to SEQ ID NO: 763281

SEQ ID NO: 763283 - protein, 183 aa, Homo sapiens
HAEKGLETVARRGGSLGRIPRQPNGCTLFMTFLPMKALKDPLACLHVGSALPSVLPNIFLSEGKNKKKSWQERKGKDRETGRERGPNFLSLVVAELALVKAEREGLTYVPLPGEGKGGRHDIDLNVGDLKGPYVPTLCFASNRQPGTFEVGLAQWGAGFCGDKMLTGAGEGGQGAAETLLGML

SEQ ID NO: 763284 - protein, 756 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 763285 - protein, 214 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKVWAGGEALP

SEQ ID NO: 763286 - protein, 111 aa, Homo sapiens
GRARLAGLFAGRPCPEGTNRLGAREVESAPAVAPWTQPEADPGPCPCGAPLARKSPPGREQLQAAAPEEEEEGTVLSLGDPDPRRGIWSRGQSRTLCLAPPLRVGQRLPGP

SEQ ID NO: 763287 - protein, 756 aa, Homo sapiens; identical to SEQ ID NO: 763284

SEQ ID NO: 763288 - protein, 270 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKDENGGRMY

SEQ ID NO: 763289 - protein, 258 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDA

SEQ ID NO: 763290 - protein, 140 aa, Homo sapiens
MACFWALGCGKLVRRHTLSTVRFGRRPDLGEGSRLTPPCPVSCLQTEELNREVATNSELVQSGKSEISELRRTMQALEIELQSQLSMKASLEGNLAETENRLLRAAVPDPGADWQRGGAAVPSFAARWSSRTRNTKSCWM

SEQ ID NO: 763291 - protein, 98 aa, Homo sapiens
AGNWDEAPYLLAGGRGCPPDSVQERTGDHPSGAYHCGRGPGWQGHLLPRAGPPDHPLRTQLPRPATQEAGRQPPHLPHSLRPLQPQPPASVPSPCFLA

SEQ ID NO: 763292 - protein, 160 aa, Homo sapiens
SNSSVPQRMSNTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDA

SEQ ID NO: 763293 - protein, 343 aa, Homo sapiens
GKGWDTRPPRCLDIVDPGVALLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDAWRKPRCPDGSPKTGTNAGAPLGGAGKGNWPATGWRRPQNGTGRPLAPQR

SEQ ID NO: 763294 - protein, 258 aa, Homo sapiens; identical to SEQ ID NO: 763289

SEQ ID NO: 763295 - protein, 324 aa, Homo sapiens
SHLGAGRWPVVMKAQGMETEEQACCNRYAHLVAYKGSGRTPAALHNFGAPLLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDA

SEQ ID NO: 763296 - protein, 258 aa, Homo sapiens; identical to SEQ ID NO: 763289

SEQ ID NO: 763297 - protein, 258 aa, Homo sapiens; identical to SEQ ID NO: 763289

SEQ ID NO: 763298 - protein, 258 aa, Homo sapiens; identical to SEQ ID NO: 763289

SEQ ID NO: 763299 - protein, 258 aa, Homo sapiens; identical to SEQ ID NO: 763289

SEQ ID NO: 763300 - protein, 258 aa, Homo sapiens; identical to SEQ ID NO: 763289

SEQ ID NO: 763301 - protein, 258 aa, Homo sapiens; identical to SEQ ID NO: 763289

SEQ ID NO: 763302 - protein, 258 aa, Homo sapiens; identical to SEQ ID NO: 763289

SEQ ID NO: 763303 - protein, 258 aa, Homo sapiens; identical to SEQ ID NO: 763289

SEQ ID NO: 763304 - protein, 245 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRPNTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDA

SEQ ID NO: 763305 - protein, 258 aa, Homo sapiens; identical to SEQ ID NO: 763289

SEQ ID NO: 763306 - protein, 258 aa, Homo sapiens; identical to SEQ ID NO: 763289

SEQ ID NO: 763307 - protein, 225 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGG

SEQ ID NO: 763308 - protein, 362 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGDQCGDGPLAPGVDLSRILNEMRDQYEKMAEKNRKDAEDWFFSKTEELNREVATNSELVQSGKSEISELRRTMQALEIELQSQLSMKASLEGNLAETENRLLRAAVPDPGADWQRGGAAVPSFAARWSSRTRNTKSCWM

SEQ ID NO: 763309 - protein, 173 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRRLSVEADINGLRRVLDELTLARADLEMQIENLKEELAYLKKNHEGGDERPAKARWVVRSMWRWTACPRRGPEPHPQRDA

SEQ ID NO: 763310 - protein, 258 aa, Homo sapiens; identical to SEQ ID NO: 763289

SEQ ID NO: 763311 - protein, 274 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDAWRLPPTAACWRERMPT

SEQ ID NO: 763312 - protein, 274 aa, Homo sapiens; identical to SEQ ID NO: 763311

SEQ ID NO: 763313 - protein, 281 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDACRLEMGNRGAGGSEREDGGPGWG

SEQ ID NO: 763314 - protein, 94 aa, Homo sapiens
KPPGTPELEGGSLTPTQLRCEMEQQNQEYKILLDVKTRLEQEIATYRRLLEGEDAHLTQYKKEPVTTRQVRTIVEEVQDGKVISSREQVHQTTR

SEQ ID NO: 763315 - protein, 290 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIGDERPAKARWVVRSMWRWTACPRRGPEPHPQRDAWVPAPAGWDLLAAWAAPSGVAATPAATALALVVAMAAALGVLMGCGWR

SEQ ID NO: 763316 - protein, 83 aa, Homo sapiens
KIRLGTRLVLIGRGSLQPFSCVPASCRRHHDHLHPPVHLLQLHQGLLRPGGRLVPHLLPAVWRPGCRLLQAGICWRPGQHPRG

SEQ ID NO: 763317 - protein, 41 aa, Homo sapiens
MEQQNQEYKILLDVKTRLEQEIATYRRLLEGEDAQVSGGAW

SEQ ID NO: 763318 - protein, 208 aa, Homo sapiens
PGGEFGTRPNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIGDERPAKARWVVRSMWRWTACPRRGPEPHPQRDAWVPAPAGWDLLAAWAAPSGVAATPAATALALVVAMAAALGVLMGCGWR

SEQ ID NO: 763319 - protein, 258 aa, Homo sapiens; identical to SEQ ID NO: 763289

SEQ ID NO: 763320 - protein, 140 aa, Homo sapiens; identical to SEQ ID NO: 763290

SEQ ID NO: 763321 - protein, 245 aa, Homo sapiens
EDSSMEKDPRKGLLTSFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGAETTRGITPGID

SEQ ID NO: 763322 - protein, 236 aa, Homo sapiens
PGGEFGTRPNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIGDERPAKARWVVRSMWRWTACPRRGPEPHPQRDAWVPAPAGWDLLAAWAAPSGVAATPAATALALVVAMAAALGVLMGCWLEVRRPGLSSLSPLLQSLPHASLPDDNKAC

SEQ ID NO: 763323 - protein, 258 aa, Homo sapiens; identical to SEQ ID NO: 763289

SEQ ID NO: 763324 - protein, 258 aa, Homo sapiens; identical to SEQ ID NO: 763289

SEQ ID NO: 763325 - protein, 258 aa, Homo sapiens; identical to SEQ ID NO: 763289

SEQ ID NO: 763326 - protein, 428 aa, Homo sapiens
SHLGAGRWPVVMKAQGMETEEQACCNRYAHLVAYKGSGRTPAALHNFGAPLLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGDQCGDGPLAPGVDLSRILNEMRDQYEKMAEKNRKDAEDWFFSKTEELNREVATNSELVQSGKSEISELRRTMQALEIELQSQLSMKASLEGNLAETENRLLRAAVPDPGADWQRGGAAVPSFAARWSSRTRNTKSCWM

SEQ ID NO: 763327 - protein, 238 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKVLDELTLARADLEMQIENLKEELAYLKKNHEGGDERPAKARWVVRSMWRWTACPRRGPEPHPQRDA

SEQ ID NO: 763328 - protein, 242 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGHQYEKMAEKNRKDAEDWFFSKTEELNREVATNSELVQSGKSEISELRRTMQALEIELQSQLSMKASLEGNLAETENRLLRAAVPDPGADWQRGGAAVPSFAARWSSRTRNTKSCWM

SEQ ID NO: 763329 - protein, 109 aa, Homo sapiens
MAEKNADARMVFSKTEELNREVATNSELVQSGKSEISELRRTMQALEIELQSQLSMKASLEGNLAETENRLLRAAVPDPGADWQRGGAAVPSFAARWSSRTRNTKSCWM

SEQ ID NO: 763330 - protein, 307 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGGDERPAKARWVVRSMWRWTACPRRGPEPHPQRDAWRKPRCPDGSPKTGTNAGAPLGGAGKGNWPATGWRRPQNGTGRPLAPQR

SEQ ID NO: 763331 - protein, 236 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEGAETTRGITPGID

SEQ ID NO: 763332 - protein, 96 aa, Homo sapiens
KLVRRHTLSTVRFGRRPDLGEGSRLTPPCPVSCLQTEELNREVATNSELVQSGKSEISELRRTMQALEIELQSQLSMVGTVLCMGEGPEEGIDHPH

SEQ ID NO: 763333 - protein, 215 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763334 - protein, 215 aa, Homo sapiens; identical to SEQ ID NO: 763333

SEQ ID NO: 763335 - protein, 215 aa, Homo sapiens; identical to SEQ ID NO: 763333

SEQ ID NO: 763336 - protein, 200 aa, Homo sapiens
GWYRPGGTDRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763337 - protein, 113 aa, Homo sapiens
MQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763338 - protein, 215 aa, Homo sapiens; identical to SEQ ID NO: 763333

SEQ ID NO: 763339 - protein, 215 aa, Homo sapiens; identical to SEQ ID NO: 763333

SEQ ID NO: 763340 - protein, 296 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCEHAMMYVEDRRRQMIEYPNVTQAKENEMEPFRKNINTQKDTQIREKVSKQQKDDRCAEPNAQPKHQIKQSLVSKICPVETLVEEAIQCAEKIASNSKIVVAMAKESVNAAFEMTLTEGSKLEKKLFYSTFATDDRKEGMTAFVEKRKANFKDQ

SEQ ID NO: 763341 - protein, 92 aa, Homo sapiens
GLQEFGRAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 763342 - protein, 215 aa, Homo sapiens; identical to SEQ ID NO: 763333

SEQ ID NO: 763343 - protein, 113 aa, Homo sapiens
CLAASAVGAVASLAHMSESTVTAVPRSLSTQEGARAALPVWKPPLLSVQRLGCSSHAAPQRPLTREGIDKCCFCTSLTDFLVFQVLSARFVLLRHWWKKPSSVQKKLPAILKL

SEQ ID NO: 763344 - protein, 137 aa, Homo sapiens
IFRAWLSSSIRPSQSALRALGGSVGSPVLLGSRWRWRWSSPVTGSQPQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 763345 - protein, 225 aa, Homo sapiens
MSTRPSVQRAMAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763346 - protein, 215 aa, Homo sapiens; identical to SEQ ID NO: 763333

SEQ ID NO: 763347 - protein, 215 aa, Homo sapiens; identical to SEQ ID NO: 763333

SEQ ID NO: 763348 - protein, 215 aa, Homo sapiens; identical to SEQ ID NO: 763333

SEQ ID NO: 763349 - protein, 215 aa, Homo sapiens; identical to SEQ ID NO: 763333

SEQ ID NO: 763350 - protein, 209 aa, Homo sapiens
MVIGRNAVCALRGAEAFAVAASVGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763351 - protein, 215 aa, Homo sapiens; identical to SEQ ID NO: 763333

SEQ ID NO: 763352 - protein, 126 aa, Homo sapiens
SFPLLLAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763353 - protein, 218 aa, Homo sapiens
VTEDVRRETQRQRRGRQPPSLGGALSSPAPAPTLSGGLLKPSAPTPGSPWKPAVPQEEQEEVEVGLNAHGAPGDPCSPIHAPSARALDGHRAGIGPLHAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAPGRQASRSCQQDLSC

SEQ ID NO: 763354 - protein, 173 aa, Homo sapiens
LPLMFPGSCAAWPLTPGPSLRAYLKPLGICWLHSCDVFLGSLITVPAMTSPSLQVRAAPRDSPVLLGSRWRWRWSSPVTGSQPQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 763355 - protein, 269 aa, Homo sapiens
MAALRVLLSCARGPLRPPVRCPAWRPFASALNALCDGLIDELNQALKIFEEDPAVGAIVLTGGDKAFAAGADIKEMQNLSFQDCYSSKFLKHWDHLTQVKKPVIAAVNGYAFGGGCEHAMMYVEDRRRQMIEYPNVTQAKENEMEPFRKNINTQKDTQIREKVSKQQKDDRCAEPNAQPKHQIKQSLVSKICPVETLVEEAIQCAEKIASNSKIVVAMAKESVNAAFEMTLTEGSKLEKKLFYSTFATDDRKEGMTAFVEKRKANFKDQ

SEQ ID NO: 763356 - protein, 215 aa, Homo sapiens; identical to SEQ ID NO: 763333

SEQ ID NO: 763357 - protein, 174 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEMERTSAACQF

SEQ ID NO: 763358 - protein, 175 aa, Homo sapiens
DVFLGSLITVPAMTSPSLQVRAAPRDSPVLLGSRWRWRWSSPVTGSQPQDAKQAGMGWGCPQEPPGNPGWEPHRNPGRHPGVPLGGAPQKPGAASRCPPHGCPTETLSCIQLSPSWEPHRNPELHPGVPHGGAPQKPRAASRCPPRGSPTETPGSIQVPPRWLHELLGPEDLGED

SEQ ID NO: 763359 - protein, 98 aa, Homo sapiens
MDCCASRGCSVPTGPATTICSSDKSCRCGVCLPSTCPHTVWLLEPTCCDNCPPPCHIPQPCVPTCFLLNSCQPTPGLETLNLTTFTQPCCEPCLPRGC

SEQ ID NO: 763360 - protein, 181 aa, Homo sapiens
MTGVSCFCHYTSHPLHHLLCSYKDPKKWNHRIADLRKQTEELSERKYDMNIMNSTGEDLQLDKSTLSARAVKAKGPVMIPYPFFQSHVEDFYVEGLPKGIFFFFFFLRWSFHSYRPGWGAMAQPCWSLQPLPPGFKKFSCLSLPSHWDYRCPPPYQANFCIFSGDAVSPCWPGQSRTPDVK

SEQ ID NO: 763361 - protein, 68 aa, Homo sapiens
MVFQDSQEGAHIRRETVSKSVCAEPWRHQRARDPAPTNFPLKCQKQRGASTSSGQHGDRVNLVFFIGE

SEQ ID NO: 763362 - protein, 75 aa, Homo sapiens
VPAMAPCCLRHQVWMYGSSPWATPDLTLPSHRPIMASCSPHAPIHQEDALHGHPMLPVAISLHPCTEPLLQGEQP

SEQ ID NO: 763363 - protein, 166 aa, Homo sapiens
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 763364 - protein, 166 aa, Homo sapiens; identical to SEQ ID NO: 763363

SEQ ID NO: 763365 - protein, 166 aa, Homo sapiens; identical to SEQ ID NO: 763363

SEQ ID NO: 763366 - protein, 166 aa, Homo sapiens; identical to SEQ ID NO: 763363

SEQ ID NO: 763367 - protein, 117 aa, Homo sapiens
KFSGGPKTFGVVSWWAFKTPRGRGGGALVGPSTGIKGEEWQLDGLSMSGIGLPGTPKRNRRWHWSSGSLVSYKSWGIGAPSSVNPGYCVSLTSSTGFQKWKDVPCEDKFSFVCKFKN

SEQ ID NO: 763368 - protein, 169 aa, Homo sapiens
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGERQRIHPPVSVLSCLAPGMELGLG

SEQ ID NO: 763369 - protein, 150 aa, Homo sapiens
FRFLGVAKMRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYWLAHKALCTEKLEQWLCEKL

SEQ ID NO: 763370 - protein, 285 aa, Homo sapiens
MNKFQGPVTLKDVIVEFTKEEWKLLTPAQRTLYKDVMLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKP

SEQ ID NO: 763371 - protein, 249 aa, Homo sapiens
MLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKP

SEQ ID NO: 763372 - protein, 333 aa, Homo sapiens
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 763373 - protein, 278 aa, Homo sapiens
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGNPTSIGSIVLAIIVPSLLLLLCLALWYMRRRSYQNIP

SEQ ID NO: 763374 - protein, 79 aa, Homo sapiens
MKCSPGTEQVGFLSGRTSIGYVLVGQYQPRSPTDAGVGRGFAVLFAQLVLDSRSIASSRLECSGAILAHCKLRLPGSRH

SEQ ID NO: 763375 - protein, 247 aa, Homo sapiens
ETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAIFRGRMPMREVDEQMFNIQDKNSSYFADWFPNNVKTAVCDIPLRGLKMSATFIGNNTAIQELFTCVSEQFTAMFRRKAFLHWYTGEGMDEMEFTEAESNMNDLVSEYQQYQDATAEEEEDEEYAEEEVA

SEQ ID NO: 763376 - protein, 114 aa, Homo sapiens
MRGQLLLRGMKEELYLLYILSFIYKDIREHLRMFQGHQKLSENAFLQRRFPEIEDNSGSLEEVNLGRQDSFSPPVALQEAIPSPLGKVDPPSPDEKSSLCLLFPLPDDPEALQL

SEQ ID NO: 763377 - protein, 402 aa, Homo sapiens
VGMAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 763378 - protein, 437 aa, Homo sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQASNTIISCLSEVQPSCPQCSVPECGCRVDGTASGAPLVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 763379 - protein, 424 aa, Homo sapiens
VGMAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 763380 - protein, 203 aa, Homo sapiens
VGMAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQASNTIISCLS

SEQ ID NO: 763381 - protein, 91 aa, Homo sapiens
MKPYTFFSSLSPECICTLLTQNRHLINISKFLLFFLATKQQSLFFSMMYMPFYHLALNYLSNLISSHSPICFPCCGCTELLRALSTLHAIL

SEQ ID NO: 763382 - protein, 73 aa, Homo sapiens
GQESFKKQEKTRKTPKGPSSVEDIKSKMQASIEKGGSLPKVEAKFINYVKNCFRTTDQETIQDPGSGGSLFRK

SEQ ID NO: 763383 - protein, 933 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYVSPVSSLGTCRRRLPGRRMREQVPCDGTISLPTWASGPQERDPGVSSSEESQPLLILMGPHLPSAIGPRPWETEGTGSTLQLPGQGLRHTGEWRKCDIKYRFLLLLNLGPTVLAAAMLLLPLHWYRGSLFAIVPNTLYFIISVSPYLSFILCLASVYIRVETPDGRSALKLANLTPVKSSQRRVPETLSASHLHHLAHSPLTTNTQSHTVTHSHTHTYVTHSQAHLITPTPTHGPTVTHESHPITPTHGDRPLAPFTTKSQLWIQRCSRAGACFKQLSTQGRGRHSQAVMMQFIHSFSTGLLRAYHMPDPEPGPEDSAGKKAGTCPLRAGSREETDGEQAEQTNVCMYIRVYAKLYIVVRVKMKGGEWEGLCVESLKPPKGGEGREGRVFCSRSSWAEQVPGGRWRLSPALGPAHAGHVAGLTPPALWLGHGACLCLLPSLSSPSPVGCSPAPALLLSEGCVHPCAPQDHGSWQIPNSPLLLPRGQLRVFWVGVMGCGMMPAGMEEMGWHGYGGGRIPLLSLHCREEGFENLWGKCGRPAADMGPSGLCCHRAWPSACLSGSLEEATVIEPVSLSHSLPFSSLSWVGEGGAQCPLPCTPLPPPAWRLGPGLWGWGGGHPLGCPSPVPDSPVFLQPGLVPKQGEAPGVGLAHLGLSPAPKWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWEQME

SEQ ID NO: 763384 - protein, 263 aa, Homo sapiens; identical to SEQ ID NO: 754360

SEQ ID NO: 763385 - protein, 230 aa, Homo sapiens
MPGKHQHFQEPEVGCCGKYFLFGFNIVFWFSVFLGLIFFLELATGILAFVFKDWIRDQLNLFINNNVKAYRDDIDLQNLIDFAQEYEDVLNTQCGYDVRLKLELEQQGFIHTKGCVGQFEKWLQDNLIVVAGVFMGIALLQVPLWPHVPLPLPGPPSLSPHLSSVLQIFGICLAQNLVSDIKAVKANWLRPPEAMATCLAYAGLWGAPQDPPTILLTGKAAGDVPAGTEP

SEQ ID NO: 763386 - protein, 230 aa, Homo sapiens; identical to SEQ ID NO: 763385

SEQ ID NO: 763387 - protein, 230 aa, Homo sapiens; identical to SEQ ID NO: 763385

SEQ ID NO: 763388 - protein, 230 aa, Homo sapiens; identical to SEQ ID NO: 763385

SEQ ID NO: 763389 - protein, 230 aa, Homo sapiens; identical to SEQ ID NO: 763385

SEQ ID NO: 763390 - protein, 230 aa, Homo sapiens; identical to SEQ ID NO: 763385

SEQ ID NO: 763391 - protein, 50 aa, Homo sapiens
MSQCQPRFKIEEIDYTSTWKKIQGHIAKEWKELTAAIFEKVHHTHRFRFL

SEQ ID NO: 763392 - protein, 141 aa, Homo sapiens
MNKVFIPVSCLNSPEHVFSPAFSLNSMQVKSQPFFFFSFFTDSHSVSQAGVQWRDLSSLQPPPPRFKQFSCISLWSSWDHRCTPPRLDEVIGFVSCTRSLPVHPATVRGHCLDPGGDPCSLQLCHPLCIPTCSSLIWPLSK

SEQ ID NO: 763393 - protein, 150 aa, Homo sapiens
MGHLDKEGLCTQGSSFSWLLRVLNDGISLGLTPCLWDMYLLEGEQMLMLITSIAFKVQRSLYEETNKETWGPATPRALKGTGRARPICESLHSSLQALTASESSRGPSLLQTPPRVPGQQALSRGDKGISVSLSLPSLPSRRGRCGRIIG

SEQ ID NO: 763394 - protein, 157 aa, Homo sapiens
CPFPFVNTTEFSNTMNTMVSSILYADGSQICIYTHLPPTEHLNLGFSWTPDPSLLFLLLVKSIIIHSGSKARIVCLYIISQNEINHKKQPHKAKHQSGYHEALSLREKGRDGRSAAIPTPPPYHNLALGTVHCNLPSPHWTKQLSCCSTQLLLSTLK

SEQ ID NO: 763395 - protein, 133 aa, Homo sapiens
MMLNSDTMELDLPPTHSETESGFSDCGGGAGPDGAGPGGPGGGQARGPEPGEPGRKDLQHLSREERRRRRRATAKYRTAHATRERIRVEAFNLAFAELRKLLPTLPPDKKLSKIEILRLAICYISYLNHVLDV

SEQ ID NO: 763396 - protein, 278 aa, Homo sapiens
GIVLTTCGDRRAHRAGVSAAPILRAGELVWSREQVPAPPASRTVPGPGTSAGSSQPLPHSLDVVAWASSRWRAGSCWKFLLGFLGSNMPTSKTPSSRLPLFWRWSVQGVGPACVGVRMGAVDTKGRVCDQVCVHMCRVQTHGCHPLRSVTVRPDPSPAAPPPHPGPPRQLSQGAQACLAPQPSGNPARRPLQVGSGPQVAKQRQQQPRLTPCPSLWRPGTPAISTTWVRLSLSGSPARVPPGVLGHLRGSLMGQAGQSELRALSGWCPNLSTPHSFPP

SEQ ID NO: 763397 - protein, 472 aa, Homo sapiens
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 763398 - protein, 411 aa, Homo sapiens
MALQIPPSAPSPLTSCTWAQMTFSTKTSKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 763399 - protein, 472 aa, Homo sapiens; identical to SEQ ID NO: 763397

SEQ ID NO: 763400 - protein, 248 aa, Homo sapiens
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMETSFFSFFILLYSFAIHRYIPFILWPISDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 763401 - protein, 216 aa, Homo sapiens [sequence omitted]

SEQ ID NO: 763402 - protein, 146 aa, Homo sapiens
MQAGKPILYSYFRSSCSWRVRIALALKGIDYETVPINLIKDGGQQFSKDFQALNPMKQVPTLKIDGITIHQSLAIIEYLEETRPTPRLLPQDPKKRASVRMISDLIAGGIQPLQNLSVLKQVGEEMQLTWAQNAITCGFNGESSPL

SEQ ID NO: 763403 - protein, 169 aa, Homo sapiens
RRRACRDREGRPARGGGDWAGGVGLRELQLPAAPRYGAWLGELGRARGDRKDLSSPAPRFTRTKDTGLIRRVSLSLSRRQVPGAKFLGLEEGVARSARCRRGSPSSIPISGTPCGKKFAPRPWLPTISAPQSAAIPGSELCQDEAVALSISSLGLPRNPPRGSEDLVHR

SEQ ID NO: 763404 - protein, 161 aa, Homo sapiens
MKQVPTLKIDGITIHQSLAIIEYLEETRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 763405 - protein, 177 aa, Homo sapiens [sequence omitted]

SEQ ID NO: 763406 - protein, 119 aa, Homo sapiens
MKQVPTLKIDGITIHQSNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 763407 - protein, 78 aa, Homo sapiens
SPATDSGVCTLMGTHRDLFQVTMADLCLVPQVANAERFKVDLTPYPTISSINKRLLVLEAFQVSHPCRQPDTPTELRA

SEQ ID NO: 763408 - protein, 216 aa, Homo sapiens [sequence omitted]

SEQ ID NO: 763409 - protein, 216 aa, Homo sapiens [sequence omitted]

SEQ ID NO: 763410 - protein, 174 aa, Homo sapiens
MQAGKPILYSYFRSSCSWRVRIALALKGIDYETVPINLIKDGGQQFSKDFQALNPMKQVPTLKIDGITIHQSNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 763411 - protein, 117 aa, Homo sapiens
SSLETWLPHSHQQPCPVCHSVGRPFHNYGGQGPESFVSPPCAQNKMFMWPPHSPGADPTEHSGHILCRRRGKLSPDLPRPSHSGCLPHADLPQAQSFLRRRLQGDLCAMGHSSAHSH

SEQ ID NO: 763412 - protein, 161 aa, Homo sapiens; identical to SEQ ID NO: 763404

SEQ ID NO: 763413 - protein, 187 aa, Homo sapiens
MQAGKPILYSYFRSSCSWRVRIALALKGIDYETVPINLIKDGGQQFSKDFQALNPMKQVPTLKIDGITIHQSLAIIEYLEETRPTPRLLPQDPKKRASVRMISDLIAGGIQPLQNLSVLKQVGEEMQLTWAQNAITCGFNALEQILQSTAGIYCVGDEVTMADLCLVPQVANAERVCSGIFQRLYDM

SEQ ID NO: 763414 - protein, 74 aa, Homo sapiens
IYGSVGLTNVNFPFLTLITAAAATICAPYHVPSTVLSAFYGMPLSVLSTMPCSVHYYYPCFTDEKTEDKRLNNW

SEQ ID NO: 763415 - protein, 103 aa, Homo sapiens
MPLSCSGDVGDSHRLSSLPARGRLPAGPLSPVQPHVLPLSNGVSTPASLKHQHPLLSCLAAFVHDISHQRPTSSNLSTFARAGRSHFWKLSVTIPTRSTVSLP

SEQ ID NO: 763416 - protein, 266 aa, Homo sapiens
RKARYEAWVESAEAALEGEDGAQTLTMTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 763417 - protein, 240 aa, Homo sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 763418 - protein, 240 aa, Homo sapiens; identical to SEQ ID NO: 763417

SEQ ID NO: 763419 - protein, 240 aa, Homo sapiens; identical to SEQ ID NO: 763417

SEQ ID NO: 763420 - protein, 240 aa, Homo sapiens; identical to SEQ ID NO: 763417

SEQ ID NO: 763421 - protein, 240 aa, Homo sapiens; identical to SEQ ID NO: 763417

SEQ ID NO: 763422 - protein, 180 aa, Homo sapiens
MGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 763423 - protein, 240 aa, Homo sapiens; identical to SEQ ID NO: 763417

SEQ ID NO: 763424 - protein, 85 aa, Homo sapiens
GTTPMLSWLNIRVSIKEPSKEDHNEHHRQYFRVGVDPDQDPPPNNDSFQVLQGDSPDSARGNWTKQESTWIFRRWYSFDHNYLKP

SEQ ID NO: 763425 - protein, 168 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEPRPRLKTNALSGLGPGGWHGRAAYTTSQPTPPEPALH

SEQ ID NO: 763426 - protein, 123 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRIVYKYDSENF

SEQ ID NO: 763427 - protein, 484 aa, Homo sapiens
EVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHSRREPVRDVGRRRPEDYDIHNSRKKPRIDYPPEFHQRPEGIERFTIQEVTDILGGREKCFKWSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 763428 - protein, 170 aa, Homo sapiens
HASRTRGSTHASARKWTRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 763429 - protein, 504 aa, Homo sapiens
EVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 763430 - protein, 504 aa, Homo sapiens; identical to SEQ ID NO: 763429

SEQ ID NO: 763431 - protein, 504 aa, Homo sapiens; identical to SEQ ID NO: 763429

SEQ ID NO: 763432 - protein, 221 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEE

SEQ ID NO: 763433 - protein, 221 aa, Homo sapiens; identical to SEQ ID NO: 763432

SEQ ID NO: 763434 - protein, 111 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYWDIKIEETALMLSKSL

SEQ ID NO: 763435 - protein, 237 aa, Homo sapiens
RPPTTTKLAACRPEETHGADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEE

SEQ ID NO: 763436 - protein, 171 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRTRISMLKNYRYLNTCGRSEGHSANVAWYAQPPTPWKTNVLSGLRTAGCTTREGPPHTP

SEQ ID NO: 763437 - protein, 504 aa, Homo sapiens; identical to SEQ ID NO: 763429

SEQ ID NO: 763438 - protein, 129 aa, Homo sapiens [sequence omitted]

SEQ ID NO: 763439 - protein, 114 aa, Homo sapiens
MEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 763440 - protein, 504 aa, Homo sapiens; identical to SEQ ID NO: 763429

SEQ ID NO: 763441 - protein, 504 aa, Homo sapiens; identical to SEQ ID NO: 763429

SEQ ID NO: 763442 - protein, 396 aa, Homo sapiens
EVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGWCGGCS

SEQ ID NO: 763443 - protein, 73 aa, Homo sapiens
MAADSREEKDGELNVLDDILTEVPEQDDELYNPESEQDKNEKKDQSYSSEQLSCFRYLPYTSLTKYFIYLFIY

SEQ ID NO: 763444 - protein, 231 aa, Homo sapiens
MESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSEVVNIIADIKQKAILFEALELFIHPDLVFYMTADSFFFKHQRIGLEVDRRASRSSQSSKEEVNSEEYGSDHETGSSGSSDEQGNNTENEEEGVEEDVEEDEEVEEDAEEDEEVDEDGEEEEEEEEEEEEE

SEQ ID NO: 763445 - protein, 178 aa, Homo sapiens
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKECVASRDLNFGKK

SEQ ID NO: 763446 - protein, 642 aa, Homo sapiens
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKELYKNIMKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 763447 - protein, 642 aa, Homo sapiens; identical to SEQ ID NO: 763446

SEQ ID NO: 763448 - protein, 642 aa, Homo sapiens; identical to SEQ ID NO: 763446

SEQ ID NO: 763449 - protein, 149 aa, Homo sapiens
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKLGNCLFTAG

SEQ ID NO: 763450 - protein, 401 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763451 - protein, 179 aa, Homo sapiens
DHASDPRVRLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763452 - protein, 401 aa, Homo sapiens; identical to SEQ ID NO: 763450

SEQ ID NO: 763453 - protein, 401 aa, Homo sapiens; identical to SEQ ID NO: 763450

SEQ ID NO: 763454 - protein, 333 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNP

SEQ ID NO: 763455 - protein, 195 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGLC

SEQ ID NO: 763456 - protein, 286 aa, Homo sapiens
LGEAAVITLFFTLGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763457 - protein, 188 aa, Homo sapiens
MIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763458 - protein, 304 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGINKWWNNLSDGQRTVTGIIAANVLVFCLWRVPSLQRTMIRYFTSNPASSVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763459 - protein, 351 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASSVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763460 - protein, 117 aa, Homo sapiens
AAEVVAQLGLVRSGHGGAEVGKMAWRGWAQRGWGCGQAWGASVGGRSCEELTAVLTPPQLLGRRYYSCKCPCILFMESTFSAADNDQIFHIESSLKGPNNTKKHTSKQYSTKKHRIN

SEQ ID NO: 763461 - protein, 401 aa, Homo sapiens; identical to SEQ ID NO: 763450

SEQ ID NO: 763462 - protein, 367 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 763463 - protein, 384 aa, Homo sapiens
AAEVVAQLGLVRSGHGGAEVGKMAWRGWAHCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 763464 - protein, 317 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASSVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 763465 - protein, 351 aa, Homo sapiens; identical to SEQ ID NO: 763459

SEQ ID NO: 763466 - protein, 174 aa, Homo sapiens
AAEVVAQLGLVRSGHGGAEVGKMAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGRSTWVRSTWPGRPNPDIIVDSGRPMQSHRTKSSSCDRLIPIMALE

SEQ ID NO: 763467 - protein, 67 aa, Homo sapiens
RRPRTMDPPGFRTGRDYGFEKTTEGALGLSAIFLGKPLRHESQVEEEANAQAEAQKKKDEAEVQVNR

SEQ ID NO: 763468 - protein, 72 aa, Homo sapiens
AAENYGSPGLQDRPRLRLRERPQKGLSALAPFFWKPLRHESQGERFLVVSLGGRSWRVVARRRSGGRSECAG

SEQ ID NO: 763469 - protein, 67 aa, Homo sapiens
MTGGGKKRGVEEEKAPRGPKKGCFHVNTKLFVAHKGGEKLGEGHPNIKRRRKKFEKNTGTPLDLHNN

SEQ ID NO: 763470 - protein, 72 aa, Homo sapiens; identical to SEQ ID NO: 763468

SEQ ID NO: 763471 - protein, 67 aa, Homo sapiens; identical to SEQ ID NO: 763467

SEQ ID NO: 763472 - protein, 67 aa, Homo sapiens; identical to SEQ ID NO: 763467

SEQ ID NO: 763473 - protein, 311 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 763474 - protein, 309 aa, Homo sapiens
QAECLSALSLNPLYPLSAEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 763475 - protein, 645 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 763476 - protein, 275 aa, Homo sapiens
STGVFTTMEKAGAHLQGGAHRQVITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 763477 - protein, 682 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCL

SEQ ID NO: 763478 - protein, 764 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTHTHTHTHTQIIKKCMLFKKKSKISQRTVSPPSFIESIFLHFRASVDSEGLLFAKKTKLA

SEQ ID NO: 763479 - protein, 89 aa, Homo sapiens
PAVAASSAPATHTSYSEGPAAPAPKPRVVTTASIRPSVYQPGKRQSRRGGCRKPWAGSRSHKSQEVALGAHPQKNGKQGLANDAPPSVP

SEQ ID NO: 763480 - protein, 759 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVRPRSGHERQPGGTQPPALRRGPAQAPQAPRSSGPPLALPSPGPPPSPHSAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 763481 - protein, 497 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVTPQWPPLQHLPPTPATVRAPPPLHPSPGLSPLPASGLLSTSQCLHLPTARPQGPITVPLPTPPPLPLPTPPPLPLPTPPHLSPPTLHPQHQPIPPHLPPTINPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 763482 - protein, 147 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVRASLLRTLP

SEQ ID NO: 763483 - protein, 708 aa, Homo sapiens
TGRLYSRSSTQPGWAARDRTEAAADSTSMSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 763484 - protein, 433 aa, Homo sapiens
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 763485 - protein, 433 aa, Homo sapiens; identical to SEQ ID NO: 763484

SEQ ID NO: 763486 - protein, 433 aa, Homo sapiens; identical to SEQ ID NO: 763484

SEQ ID NO: 763487 - protein, 433 aa, Homo sapiens; identical to SEQ ID NO: 763484

SEQ ID NO: 763488 - protein, 433 aa, Homo sapiens; identical to SEQ ID NO: 763484

SEQ ID NO: 763489 - protein, 433 aa, Homo sapiens; identical to SEQ ID NO: 763484

SEQ ID NO: 763490 - protein, 433 aa, Homo sapiens; identical to SEQ ID NO: 763484

SEQ ID NO: 763491 - protein, 296 aa, Homo sapiens
MLAVVNQARGITSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 763492 - protein, 167 aa, Homo sapiens
MALPPHHPPWGPPVPQHGSHPSVWTLALPPGEPGSCPGGHVSVHVCELCMCVHVARRGKKRVLLCGDRHHSVEGFKLSQDEARVTPSAKNKCLLWYQVCSLLKSEEQREAQFQSAVFTPVRGCRPIQRWPAPSRGGSVLACHSAHLDKGMASLGIGCGTEALNRFKK

SEQ ID NO: 763493 - protein, 116 aa, Homo sapiens
LLVWGRRSHKALKITAHLTSIWMAVIKRTESNAGENVGKLEPLCIAGGNVKRCSYYRKWLRVLKKLNAELPYNPAIPLLGVYPPNVESRDSKRHVYTHVHSIGIHTLYWFCFSSES

SEQ ID NO: 763494 - protein, 60 aa, Homo sapiens
GSPGPRIETADGKEGPAEFPELWLGHGIGTHTGSSSYTGLGWQGKGGWCRSMQQFREQVR

SEQ ID NO: 763495 - protein, 260 aa, Homo sapiens
MKKMAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 763496 - protein, 227 aa, Homo sapiens
MKKMAPAMESPTLLCVALLFFAPDGVLAVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 763497 - protein, 260 aa, Homo sapiens; identical to SEQ ID NO: 763495

SEQ ID NO: 763498 - protein, 234 aa, Homo sapiens
RGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 763499 - protein, 90 aa, Homo sapiens
PAELEDDASGHENNDCWDRSQKRRRPSGQQGALRQEESQQPLTDLSPAGVTVLGAFGDSPTPTPDHEEPRGGPRPGMPHPKGAPAFQLNR

SEQ ID NO: 763500 - protein, 565 aa, Homo sapiens
MASTWAIQAHMDQDEPLEVKIEEEKYTTRQDWDLRKNNTHSREVFRQYFRQFCYQETSGPREALSRLRELCHQWLRPETHTKEQILELLVLEQFLTILPEELQAWVQEQHPESGEEVVTVLEDLERELDEPGEQVSVHTGEQEMFLQETVRLRKEGEPSMSLQSMKAQPKYESPELESQQEQVLDVETGNEYGNLKQEVSEEMEPHGKTSSKFENDMSKSARCGETREPEEITEEPSACSREDKQPTCDENGVSLTENSDHTEHQRICPGEESYGCDDCGKAFSQHSHLIEHQRIHTGDRPYKCEECGKAFRGRTVLIRHKIIHTGEKPYKCNECGKAFGRWSALNQHQRLHTGEKHYHCNDCGKAFSQKAGLFHHIKIHTRDKPYQCTQCNKSFSRRSILTQHQGVHTGAKPYECNECGKAFVYNSSLVSHQEIHHKEKCYQCKECGKSFSQSGLIQHQRIHTGEKPYKCDVCEKAFIQRTSLTEHQRIHTGERPYKCDKCGKAFTQRSVLTEHQRIHTGERPYKCDECGNAFRGITSLIQHQRIHTGEKPYQCDECGKAFRQR

SEQ ID NO: 763501 - protein, 565 aa, Homo sapiens; identical to SEQ ID NO: 763500

SEQ ID NO: 763502 - protein, 565 aa, Homo sapiens; identical to SEQ ID NO: 763500

SEQ ID NO: 763503 - protein, 604 aa, Homo sapiens
MASTWAIQAHMDQDEPLEVKIEEEKYTTRQDWDLRKNNTHSREVFRQYFRQFCYQETSGPREALSRLRELCHQWLRPETHTKEQILELLVLEQFLTILPEELQAWVQEQHPESGEEVVTVLEDLERELDEPGEQVSVHTGEQEMFLQETVRLRKEGEPSMSLQSMKAQPKYESPELESQQEQVLDVETGNEYGNLKQEVSEEMEPHGKTSSKFENDMSKSARCGETREPEEITEEPSACSREDKQPTCDENGVSLTENSDHTEHQRICPGEESYGCDDCGKAFSQHSHLIEHQRIHTGDRPYKCEECGKAFRGRTVLIRHKIIHTGEKPYKCNECGKAFGRWSALNQHQRLHTGEKHYHCNDCGKAFSQKAGLFHHIKIHTRDKPYQCTQCNKSFSRRSILTQHQGVHTGAKPYECNECGKAFVYNSSLVSHQEIHHKEKCYQCKECGKSFSQSGLIQHQRIHTGEKPYKCDVCEKAFIQRTSLTEHQRIHTGERPYKCDKCGKAFTQRSVLTEHQRIHTGERPYKCDECGNAFRGITSLIQHQRIHTGEKPYQCDECGKAFRQRKKTSYKEILLKNHSEPQAGVNLLLSSLIPEWQSCFRRDL

SEQ ID NO: 763504 - protein, 565 aa, Homo sapiens; identical to SEQ ID NO: 763500

SEQ ID NO: 763505 - protein, 132 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGMMFV

SEQ ID NO: 763506 - protein, 206 aa, Homo sapiens
SPTPSSGRSRDPRLSKLGRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPSCSAVPRS

SEQ ID NO: 763507 - protein, 109 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQSSGGKSQIKVLAEITFPLGESFFASSI

SEQ ID NO: 763508 - protein, 596 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763509 - protein, 579 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTMKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763510 - protein, 473 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKKTQVTNNPGTVKIPPKRPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763511 - protein, 487 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763512 - protein, 474 aa, Homo sapiens
MAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763513 - protein, 442 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQSPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763514 - protein, 144 aa, Homo sapiens
MAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763515 - protein, 596 aa, Homo sapiens; identical to SEQ ID NO: 763508

SEQ ID NO: 763516 - protein, 343 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 763517 - protein, 596 aa, Homo sapiens; identical to SEQ ID NO: 763508

SEQ ID NO: 763518 - protein, 234 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 763519 - protein, 214 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKKTQVTNNPGTVKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 763520 - protein, 102 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRGTILCTQSLSRFLFKRKHK

SEQ ID NO: 763521 - protein, 209 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKKTQVTKKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 763522 - protein, 343 aa, Homo sapiens; identical to SEQ ID NO: 763516

SEQ ID NO: 763523 - protein, 534 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYMPWM

SEQ ID NO: 763524 - protein, 209 aa, Homo sapiens; identical to SEQ ID NO: 763521

SEQ ID NO: 763525 - protein, 488 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILG

SEQ ID NO: 763526 - protein, 337 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 763527 - protein, 237 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNG

SEQ ID NO: 763528 - protein, 129 aa, Homo sapiens
APTPRRRGNGCETLEAWELTPREQPLDNLSVKIRSRVTREQWLTTVLCEPGCLLWTQRFRLPGFGVYQDSQGNSVQAFSVGAGMDDKGDPIIQRRQRKRYPFTSLVPNTQNYVTGTMKFQHVLLTYSDL

SEQ ID NO: 763529 - protein, 214 aa, Homo sapiens; identical to SEQ ID NO: 763519

SEQ ID NO: 763530 - protein, 153 aa, Homo sapiens
QFKQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETVYIMPVVPFLSTLTHKTFAPQGQESVLLLSICLKWCQAHRRHPNLY

SEQ ID NO: 763531 - protein, 596 aa, Homo sapiens; identical to SEQ ID NO: 763508

SEQ ID NO: 763532 - protein, 493 aa, Homo sapiens [sequence omitted]

SEQ ID NO: 763533 - protein, 271 aa, Homo sapiens
MPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763534 - protein, 468 aa, Homo sapiens
PRVADAWLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTTAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVINALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763535 - protein, 596 aa, Homo sapiens; identical to SEQ ID NO: 763508

SEQ ID NO: 763536 - protein, 108 aa, Homo sapiens
HEKKHFCFHWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 763537 - protein, 596 aa, Homo sapiens; identical to SEQ ID NO: 763508

SEQ ID NO: 763538 - protein, 596 aa, Homo sapiens; identical to SEQ ID NO: 763508

SEQ ID NO: 763539 - protein, 343 aa, Homo sapiens; identical to SEQ ID NO: 763516

SEQ ID NO: 763540 - protein, 341 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKAKASAAPKPEPVPVQKGEPKEVVKPVPITSPAVVCC

SEQ ID NO: 763541 - protein, 132 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQSSYSGVTQLLRRLRQENRLNPGGGGCSELRSRLGDRTRLRLKKKKCLCSV

SEQ ID NO: 763542 - protein, 118 aa, Homo sapiens
MWSERLDIQRDNGMTICTNGTMAHNLQQPAQEANPSPAAARMDAGLPSESERLSCPTVWAPPPSCLLWEIRRVKVKLDLAQRCPQGRPELHKLPPSCLWDQLCIAPKPSSVSAFCCNN

SEQ ID NO: 763543 - protein, 403 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763544 - protein, 369 aa, Homo sapiens
MPRCPALILYLQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763545 - protein, 403 aa, Homo sapiens; identical to SEQ ID NO: 763543

SEQ ID NO: 763546 - protein, 550 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITAWVSAGLGGSGGAGHGSHVPKKGRGGERKLASSLCLGPTSASPNPTPIPHGLCLITLCCPISPLYIHLSFSIAVSFPWVSGHPISPCTSCYICLSFLPFLFHLSHLPLIVLCSLPLSCLSSNLMPISALIAPLSLPLSPLSPLYIPLSSLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763547 - protein, 323 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITAWAAAGLGGLHCQDGSS

SEQ ID NO: 763548 - protein, 403 aa, Homo sapiens; identical to SEQ ID NO: 763543

SEQ ID NO: 763549 - protein, 403 aa, Homo sapiens; identical to SEQ ID NO: 763543

SEQ ID NO: 763550 - protein, 352 aa, Homo sapiens
MSENSCPELINILTGSNYHALHIIIADCFKSWITSFCLGLAILDSFSWSLTILVLDIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763551 - protein, 360 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763552 - protein, 323 aa, Homo sapiens; identical to SEQ ID NO: 763547

SEQ ID NO: 763553 - protein, 507 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITAWVSRGLGGSGGAGHGSHVPKKGRGGERKLASSLCLGPTSASPNPTPIPHGLCLITLCCPISPLYIHLSFSIAVSFPWVSGHPISPCTSCYICLSFLPFLFHLSHLPLIVLCSLPLSCLSSNLMPISALIAPLSLPLSPLSPLYIPLSSLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763554 - protein, 134 aa, Homo sapiens
MSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763555 - protein, 213 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQICLYPDPHPLAFRDPL

SEQ ID NO: 763556 - protein, 425 aa, Homo sapiens
MPRCPALILYLQSSARITISEGSCPERITTITGSTAAVFHAVSMIAFKLDEDLCAAPANGGNVSRPPVTLRLVIPASQCGSLIGKAGTKIKEIREEVRGEIYHPQGIRGKGAVVRGVLGLWRPPHLESSEPGQPFSGLWEQPEVAPVLCLQTTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763557 - protein, 343 aa, Homo sapiens
MEAGQVAARTHSQVAVAPASPDRMSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIREVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763558 - protein, 403 aa, Homo sapiens; identical to SEQ ID NO: 763543

SEQ ID NO: 763559 - protein, 403 aa, Homo sapiens; identical to SEQ ID NO: 763543

SEQ ID NO: 763560 - protein, 403 aa, Homo sapiens; identical to SEQ ID NO: 763543

SEQ ID NO: 763561 - protein, 426 aa, Homo sapiens
MEAGQVAARTHSQVAVAPASPDRMSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763562 - protein, 77 aa, Homo sapiens
SRAPGRPGSAPVITPHCSQLMSLAVVSGRLSRGQCGTERPSRRAAAAAAAGQPQREPARLQRGHTRRSLWPQPRLTE

SEQ ID NO: 763563 - protein, 77 aa, Homo sapiens; identical to SEQ ID NO: 763562

SEQ ID NO: 763564 - protein, 369 aa, Homo sapiens; identical to SEQ ID NO: 763544

SEQ ID NO: 763565 - protein, 377 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLAHHLQISCCFH

SEQ ID NO: 763566 - protein, 296 aa, Homo sapiens
IAHARPPVVNRPRLHQDQEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763567 - protein, 360 aa, Homo sapiens; identical to SEQ ID NO: 763551

SEQ ID NO: 763568 - protein, 432 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACCCLETASPNSGGTPKFGSRSTDCPQFTAPMKGLRQRKPLTRWEHLCHPLQRNSAKTCPLVSTAPQAAAGTEAQGQKGRTEKDRRGRNPTATAEGGLSNIGLDTERTTVNATDEDQQTQKTGRQS

SEQ ID NO: 763569 - protein, 209 aa, Homo sapiens
VPFFLAFLSTNPIPHGLCLITLCCPISPLYIHLSFSIAVSFPWVSGHPISPCTSCYICLSFLPFLFHLSHLPLIVLCSLPLSCLSSNLMPISALIAPLSLPLSPLSPLYIPLSSLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 763570 - protein, 157 aa, Homo sapiens
MPRCPALILYLQSSARITISEGSCPERITTITGSTAAVFHAVSMIAFKLDEDLCAAPANGGNVSRPPVTLRLVIPASQCGSLIGKAGTKIKEIREATLSGSFRALIVQVPGHLCPDSPDRDVPETGPLQAMILCGGQMGLAIGQSPPKEVSVRDHFQ

SEQ ID NO: 763571 - protein, 116 aa, Homo sapiens
MNSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 763572 - protein, 116 aa, Homo sapiens; identical to SEQ ID NO: 763571

SEQ ID NO: 763573 - protein, 116 aa, Homo sapiens; identical to SEQ ID NO: 763571

SEQ ID NO: 763574 - protein, 116 aa, Homo sapiens; identical to SEQ ID NO: 763571

SEQ ID NO: 763575 - protein, 116 aa, Homo sapiens; identical to SEQ ID NO: 763571

SEQ ID NO: 763576 - protein, 116 aa, Homo sapiens; identical to SEQ ID NO: 763571

SEQ ID NO: 763577 - protein, 116 aa, Homo sapiens; identical to SEQ ID NO: 763571

SEQ ID NO: 763578 - protein, 116 aa, Homo sapiens; identical to SEQ ID NO: 763571

SEQ ID NO: 763579 - protein, 127 aa, Homo sapiens
MKDPSRSSTSPSIINEDVIINGHSHEDDNPFAEYMWMENEEEFNRQIEEELWEEEFIERCFQEMLEEEEEHEWFIPARDLPQTMDQIQDQFNDLVISDGSSLEDLVVKSNLNPNAKEFVPGVKYGNI

SEQ ID NO: 763580 - protein, 127 aa, Homo sapiens; identical to SEQ ID NO: 763579

SEQ ID NO: 763581 - protein, 114 aa, Homo sapiens
MKDPSRSSTSPSIINEDVIINGHSHEDDNPFAEYMWMENEEEFNRQIEEELWEEEFIERCFQEMLEEEEEHEWFIPARDLPQTMDQIQDQFNDLVISDGSSLEDLVVKSYFSSF

SEQ ID NO: 763582 - protein, 167 aa, Homo sapiens
SEDGRVWEQWYAPIPAFQRERATAFLLHPAAGRRGALERLLRVHTCAALETDFGVARSRARSLVASEGRADRTRGRGWRRRRVKSLPGWGVCLDWRREAAGEAHVERGSGAACGDPRRPTGFVGCRPRCCALGMEVREWRFPLMIQGCARCSLGTQIEVKNDNQHQP

SEQ ID NO: 763583 - protein, 127 aa, Homo sapiens; identical to SEQ ID NO: 763579

SEQ ID NO: 763584 - protein, 127 aa, Homo sapiens; identical to SEQ ID NO: 763579

SEQ ID NO: 763585 - protein, 127 aa, Homo sapiens; identical to SEQ ID NO: 763579

SEQ ID NO: 763586 - protein, 127 aa, Homo sapiens; identical to SEQ ID NO: 763579

SEQ ID NO: 763587 - protein, 100 aa, Homo sapiens
ILRRTRGPPKMKIERINRQIEEELWEEEFIERCFQEMLEEEEEHEWFIPARDLPQTMDQIQDQFNDLVISDGSSLEDLVVKSNLNPNAKEFVPGVKYGNI

SEQ ID NO: 763588 - protein, 102 aa, Homo sapiens
MKDPSRSSTSPSIINEDVIINGHSHEDDNPFAEYMWMENEEEFNRQNLLNAVSKKCWKRKKSMNGLFQLEISHKLWTKSKTSLMTLLSVMALLWKILWSRAI

SEQ ID NO: 763589 - protein, 356 aa, Homo sapiens
SEDGRVWEQWYAPIPAFQRERATAFLLHPAAGRRGALERLLRVHTCAALETDFGVARSRARSLVASEGRADRTRGRGWRRRRVKSLPGWGVCLDWRREAAGEAHVERGSGAACGDPRRPTGFVGCRPRCCALGEGSSRAEWRQGCGGRGTASRRRQRGLKGSLGGWPPSPLRPPLFIASFHQVCGMSLGRLRLCLLRDMAVAFFSLSLLMIWISQLSIRVLSGARVAGIALSPVPHSPGPLSLRRVPFPLPPSHRLGNKAYCFYPLYACASPRAAPTCCACAPQPRLGFGERGAEGLAGSWRLGGTLQPSTGLIRRSSFSRFFAIATPYFWLYCSSCPGKKNLWGTGNPYPRRALS

SEQ ID NO: 763590 - protein, 127 aa, Homo sapiens; identical to SEQ ID NO: 763579

SEQ ID NO: 763591 - protein, 356 aa, Homo sapiens; identical to SEQ ID NO: 763589

SEQ ID NO: 763592 - protein, 127 aa, Homo sapiens; identical to SEQ ID NO: 763579

SEQ ID NO: 763593 - protein, 127 aa, Homo sapiens; identical to SEQ ID NO: 763579

SEQ ID NO: 763594 - protein, 127 aa, Homo sapiens; identical to SEQ ID NO: 763579

SEQ ID NO: 763595 - protein, 127 aa, Homo sapiens; identical to SEQ ID NO: 763579

SEQ ID NO: 763596 - protein, 131 aa, Homo sapiens
MKDPSRSSTSPSIINEDVIINGHSHEDDNPFAEYMWMENEEEFNRQIEEELWEEEFIERCFQEMLEEEEEHEWFIPARDLPQTMDQIQDQFNDLVISDGSSLEDLVVKSNLNPNAKEFVPGVKRRRMKPRR

SEQ ID NO: 763597 - protein, 133 aa, Homo sapiens
SEDGRVWEQWYAPIPAFQRERATAFLLHPAAGRRGALERLLRVHTCAALETDFGVARSRARSLVASEGRADRTRGRGWRRRRVKSLPGWGVCLDWRREAAGEAHVERGSGAACGDPRRPTGFVGCRPRCCALG

SEQ ID NO: 763598 - protein, 111 aa, Homo sapiens
DPSASASKSAEITDVSHHAWPKENDITPHIPGGVYPPVIWFRISGRKDRDITSHIARGVTWFVISHGGEGNITLRIVKGIHSPVIQFIIFRGVEEDIMLHIAGGISPLWFG

SEQ ID NO: 763599 - protein, 39 aa, Homo sapiens
MVTKYVALLIFNGRAPQCYYLSNKKVESQSYLLLLILES

SEQ ID NO: 763600 - protein, 276 aa, Homo sapiens
WGRGVGWVQYPGRSLPVTGADWGRYLGLCCLWSGWGAGLMGHYLVLQHPWQGWVVDTIECPPRVVWGCYQGNTACSSLWVCCGHNLGAKLVVRGGRLGVVWGEAALLLPAAGCGGGHDSGGLRGRGPSPLPGLKVLEGEQLLLVLERRGCTEFSRQSSDHCRAFAPTMVTRPLPSCSVLWRPSGSPRHGVVGTTGAQGPVGGGVRNGNWYLGGEDWLGLSFCYSCSPGSPGHCGVSSPHPRSGGQLGLGGEAGLWRVGVRAFAKTGPSHPVASMTR

SEQ ID NO: 763601 - protein, 364 aa, Homo sapiens
AAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 763602 - protein, 66 aa, Homo sapiens
GDHAQARCTVRGHHGGFSTLAVDAGSMDHGCWADGERLWSVALEVVRWEAAVGRPWRMPDKGMSDT

SEQ ID NO: 763603 - protein, 66 aa, Homo sapiens; identical to SEQ ID NO: 763602

SEQ ID NO: 763604 - protein, 66 aa, Homo sapiens; identical to SEQ ID NO: 763602

SEQ ID NO: 763605 - protein, 120 aa, Homo sapiens
HASARQEHLRSHALSVHRSNRPIICKGCRRTFTSHLSQGLRRFGLCDSCTCVTDTPDDDDDLMPINLSLVEASSESQEKSDTDNDWPIYVESGEENDPAGDDSDDKPQIQPNLSDRETLT

SEQ ID NO: 763606 - protein, 114 aa, Homo sapiens
MVSPHSPSSPHLCLKPPWLPRVWIKLRSLNAPQVLGVVSPSHPSLILSHKSCLLFLQLCLVTQTLCCSNALTPSSACSQATSLQNPPCLPGGHRDPRHTVCLWQCPPAWGVFQS

SEQ ID NO: 763607 - protein, 103 aa, Homo sapiens
MVSIGLQNKGLYPMPVPKAHLSASHLDLVPSRILTSRLCLPRTLLSSAQATCFPPHTELTRYPAQGSAPPLSFRLFLCEAVVRPAPVYQATHPQIRSAFPPKL

SEQ ID NO: 763608 - protein, 194 aa, Homo sapiens
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPLPHF

SEQ ID NO: 763609 - protein, 194 aa, Homo sapiens; identical to SEQ ID NO: 763608

SEQ ID NO: 763610 - protein, 113 aa, Homo sapiens
NQLGFRIRVRGWASSWANRSSPAVSSWTPFSSSISSTMSKGSPRSPHSDKDQAFHVRLIASQLLAWDLQPHRGSKWTPTAPAPLVAPAPALAPANAKSANAPPARRAAAPAAP

SEQ ID NO: 763611 - protein, 102 aa, Homo sapiens
MKENMLRAAREKGRVTHKGKPIRLTADLSAEILQARREWGPIFNILKEKNFQPRISYPAKLSFISEGEIKYFTDKQMLRDFVTTRPALKVLLKEVPNMERNN

SEQ ID NO: 763612 - protein, 98 aa, Homo sapiens
DTRSPGPKSFVSQLDPLRPPPCLEVYASGDLESYLLYPGGSQILTLKEATTPPSDTHSCEYGNTAQEPHCREYSPGYTLNMPQGCRIVPAAWETEKGG

SEQ ID NO: 763613 - protein, 560 aa, Homo sapiens
CGPGRVTRCVLCPQEMLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 763614 - protein, 415 aa, Homo sapiens
QRSPLRSAREPTRGSSGTHRPETQVPAFSVSAPVPGGADMSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSEYDMLREMFSDSRSNNDDDEDEDDEDEDEDEDEDEDEDKEEEEEDCSEEYLERQLQAEFIESGQYRANEGTSSIVMEIQKQIEKKEKKLHKIQNKAQRQKDLIMKVENLTLKNHFQSVLEQLELQEKQKNEKLISLQEQLQRFLKK

SEQ ID NO: 763615 - protein, 302 aa, Homo sapiens
MSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSVMEIQKQIEKKEKKLHKIQNKAQRQKDLIMKVENLTLKNHFQSVLEQLELQEKQKNEKLISLQEQLQRFLKK

SEQ ID NO: 763616 - protein, 300 aa, Homo sapiens
QRSPLRSAREPTRGSSGTHRPETQVPAFSVSAPVPGGADMSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSGTLVKAKQEFQIGQVLTGYQIIFHKFIGQSK

SEQ ID NO: 763617 - protein, 424 aa, Homo sapiens
HPGPPASPAMMEKNTSEGPACSPEETASESAKVPTAEPPGEVAVSESTREEQVPKPQAPAPQAPTASTATKPAPPSEDVPSAPLLLTLDDVSSSSVTVSWEPPERLGRLGLQGYVLELCREGASEWVPVSARPMMVTQQTVRNLALGDKFLLRVSAVSSAGAGPPAMLDQPIHIRENIEAPKIRVPRHLRQTYIRQVGETVNLQIPFQGKPKPQATWTHNGHALDSQRVSMRTGDQDSILFIRSAQRSDSGRYELTVRVEDLEAKAVIDILVIEKPGPPSSIRLLDVWGCNAALQWTPPQDTGNTELLGYMVQKADKKTGQWFTVLERYHPTTCTISDLIIGNSYSFRVFSENLCGLSTSATVTKELAHIQKADIAAKPKGFIERDFSEAPSFTQPLADHTSTPGYSTQLFCSVELHPSPRSSG

SEQ ID NO: 763618 - protein, 210 aa, Homo sapiens
HPGPPASPAMMEKNTSEGPACSPEETASESAKVPTAEPPGEVAVSESTREEQVPKPQAPAPQAPTASTATKPAPPSEDVPSAPLLLTLDDVSSSSVTVSWEPPERLGRLGLQGYVLELCREGASEWVPVSARPMMVTQQTVRNPKIIWMKNKMEIQGNPKYRALSEQGVCTLEIRKPSPFDSGVYTCKAINVLGEASVDCRLEVKASAAH

SEQ ID NO: 763619 - protein, 72 aa, Homo sapiens
WALHLREGGLVRKRMLLPLPTLHLSGLQPSSAHTRGSGSMSSSRCCRPEGPGPPGLQSNSRDAQDPRFHSDG

SEQ ID NO: 763620 - protein, 424 aa, Homo sapiens; identical to SEQ ID NO: 763617

SEQ ID NO: 763621 - protein, 169 aa, Homo sapiens
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 763622 - protein, 144 aa, Homo sapiens
MPHLPGRRSPLLLCLAVRSIIMNGSNMANTSPSVKSKEDQGLSGHDEKENPFAEYMWMENEEDFNRQVEEELQEQDFLDRCFQEMLDEEDQDWFIPSRDLPQAMGQLQQQLNGLSVSEGHDSEDILSKSNLNPDAKEFIPGEKY

SEQ ID NO: 763623 - protein, 778 aa, Homo sapiens
MYFYTVANLAGPNVSLLVIDLYIIGIIYSTLKFQDENNLSLSFQGKKPKWMHFQFLQAFELQQKIQGYSLGLGKCSPGSLGQFLTIIVEFWESHKGETRNDPKERLDLCYTPLVSKVTAAGVPLFFFFSFFLRHSLTLSPRLECSGMTIAHCSIKFLGSSNPPILASRVAGTTGTHHHGQLIIFIIFIFCRDWILLYFPSYSVNCCAQVILPSQPPKVLGLKAGCGEPPQPGVSLIKVIMLTMAKILSNIFQIVYYYCFDFGEAGKYGGEVNTLIINTCERGKLCEEAAKVNSTNESSCTEGCCKPQVDKMTAQAPEPSGTQESTQTVRRGQAFVNKGPTITGYIIFLSLGDIEVLKLLEIMTDLTKIWRRPHNWEGLSVPSHSPLGYTRTSLVCEVGGENRRIDSNLVCSGGLDVLLPLSTFPHVTHCTLHCSQGSLVLPVDRAPLQPLLCCLVNFLHRLGLVTIWKQFFWVFFLCFNLLTMKLLLVTGTGEQEANPGKHASFLHTTYVTCPHWPTPYCCSQSVWFLEARGNRIAGYTNLYKVSGRRFTFPSPRGQERNLKGTDAPSLFQKKKLPQIVLLGVSFVTFTELSPQSYLPIGYFLNKNKHFEANMTKMKIKSSKTCTSVQLLKCAYYKTVKYSLCKSSLSSYSVLLIMSLQKCLMLEGWFGRQGILFLKQLNEAYVTYHKTPISSVHFSDFSNFPQWCSCNYYSVLEHFYPPNKILHALLQLILFLPPATTNLLSLEICPFWTVQINGIIQYVVPWVWLFYLANVFEVCP

SEQ ID NO: 763624 - protein, 815 aa, Homo sapiens
MVRLVFIRGNFDVEFKPLLCLNFFKLATRSLRICIEMEHVFLTVANLAGPNVSLLVIDAVIIGIIYSTLKFQDENNLSLSFQGKKPKGMHFQFLQAFELQQKIQGYSLGLGKCSPGSLGQFLTIIVEFWESHKGETRNDPKERLTFVNTFSFQSHSSWGPSFFFSFSFFLRHSLTLSPRLECSGMTIAHCSIKFLGSSNPPILASRVAGTTGTHHHGQLIIFIIFIFCRDWILLYFPSYSVNCCAQVILPSQPPKVLGLYAGCGEPPQPGVSLIKVIMLTMAKILSNIFQIVYYYCFDFGEAGKKGGEVNTLIINTCERGKLCEEAAKVNSTNESSCTGLLQTPGRQMTAQAPEPSGTQEIYPTVRRGQAFVNKGPTITGYIIFLSLGDIEVIETVRNLTDLTKIWRRPHNWEGLSVPEPLSSGITRTSLVCEVGGENRRIDSNLVCSGGLDVLLPLSTFPHVTHCTLHCSQGSLVLPVDRAPLQPLLCCLVNFLHRLGYVTIWKQFFWVFFLCFNLLTMKLLLVTGTGEQEANPGKHASFRTPLSHLPSLANPLLLFPVSLVFRGIVAIEELDTLISTRCQAGDSPSPVPGDRREICKGTDAPSLFQKKKLPQIVLLGVSFVTFTELSPQSYLPIGYFLNKNKHFEAEYDKNEDKILKTCTSVQLLKCAYYKTVKYSLCKSSLSSYSVLLIMSLQKCLMLEGWFGRQGILFLKQLNEAYVTYHKTPISSVHFSDFSNFPQWCSCNYYSVLEHFYPPNKILHALLQLILFLPPATTNLLSLEICPFWTVQINGIIQYVVPWVWLFYLANVFEVCP

SEQ ID NO: 763625 - protein, 815 aa, Homo sapiens; identical to SEQ ID NO: 763624

SEQ ID NO: 763626 - protein, 815 aa, Homo sapiens; identical to SEQ ID NO: 763624

SEQ ID NO: 763627 - protein, 722 aa, Homo sapiens
MHFQFLQAFELQQKIQGYSLGLGKCSPGSLGQFLTIIVEFWESHKGETRNDPKERLDLCYTPLVSKVTAAGVPLFFFFSFFLRHSLTLSPRLECSGMTIAHCSIKFLGSSNPPILASRVAGTTGTHHHGQLIIFIIFIFCRDWILLYFPSYSVNCCAQVILPSQPPKVLGLKAGCGEPPQPGVSLIKVIMLTMAKILSNIFQIVYYYCFDFGEAGKKGGEVNTLIINTCLRGKLCEEAAKVNSTNESSCTGLLQTPGRQMTAQAPEPSGTQEIYPTVRRGQAFVNKGPTITGYIIFLSLGDIEVIETVRNLTDLTKIWRRPHNWEGLSVPEPLSSGITRTSLVCEVGGENRRIDSNLVCSGGLDVLLPLSTFPHVTHCTLHCSQGSLVLPVDRAPLQPLLCCLVNFLHRLGYVTIWKQFFWVFFLCFNLLTMKLLLVTGTGEQEANPGKHASFRTPLSHLPSLANPLLLFPVSLVFRGIVAIEELDTLISTRCQAGDSPSPVPGDRREICKGTDAPSLFQKKKLPQIVLLGVSFVTFTELSPQSYLPIGYFLNKNKHFEAEYDKNEIKSSKTLYYVYSYYKCAYYKTVKYSLCKSSLSSYSVLLIMSLQKCLMLEGWFEEAGNPFLKTTLMRHMLHIIKHPFQVYISVILVTSLSGVAVTITQFENIFIPPNKILHALLQLILFLPPATTESTFSINLPFLDSSNQWNHTICGPLGLAFLLS

SEQ ID NO: 763628 - protein, 815 aa, Homo sapiens; identical to SEQ ID NO: 763624

SEQ ID NO: 763629 - protein, 198 aa, Homo sapiens
KLRLSTRLVLIRPRLIFASTGARAVAHSPQPTAMGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 763630 - protein, 214 aa, Homo sapiens
AGSRTPPDVCPQAYNRAGAACGSRRLRGSELIFASTGARAVAHSPQPTAMGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 763631 - protein, 232 aa, Homo sapiens
ASVQRRLPEPPGEPGLGPGVETLPGFQSGQEADGRLSSHESLNSESLVRRHGENLGSSTDDGDSGEGKGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 763632 - protein, 95 aa, Homo sapiens
MLAGNEFQVSLSSSMSVSELKAQITQKIGVHAFQQRLAVHPSGVALQDRVPLASQGLGPGSTVLLVVDKCDEPLSILVRNNKGRSSTYEVRLTQT

SEQ ID NO: 763633 - protein, 109 aa, Homo sapiens
RVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 763634 - protein, 214 aa, Homo sapiens; identical to SEQ ID NO: 763630

SEQ ID NO: 763635 - protein, 81 aa, Homo sapiens
AAAPTSEWCSTYEVRLTQTVAHLKQQVSGLEGVQDDLFWLTFEGKPLEDQLPLGEYGLKPLSTVFMNLRLRGGGTEPGGRS

SEQ ID NO: 763636 - protein, 367 aa, Homo sapiens [sequence omitted]

SEQ ID NO: 763637 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 763638 - protein, 164 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPDYCGMILHHSHSTLDSGKGHCCLETLQP

SEQ ID NO: 763639 - protein, 115 aa, Homo sapiens
KIQNLQKPAADIEEPIYTMDKQSSAGGVKRSVPCESNEVNETMPETPTGDSDPQPAPKKMKTSESSTILVVRYRRNVKRTSPEELLNDHARENRINPLQMEEEEFMEIMVEIPAK

SEQ ID NO: 763640 - protein, 268 aa, Homo sapiens
EALEAASSDMPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGRKEPPRLGLL

SEQ ID NO: 763641 - protein, 243 aa, Homo sapiens
MDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGRKEPPRLGLL

SEQ ID NO: 763642 - protein, 157 aa, Homo sapiens
ATPKKLDSTQTTHSSSLIAGHTGPVPKKPQDLAHTGISSGLIAGSSIQNPKVSLEPLPARLLQQGLQRSSQIHTSSSSQTHVSSSSQAQIAASSHALGTSEAQDASSLTQVTKVHQHSAVQQNYVSPLQATISTIVKRRPVDASIASSKISRRYTGP

SEQ ID NO: 763643 - protein, 532 aa, Homo sapiens
ATPKKLDSTQTTHSSSLIAGHTGPVPKKPQDLAHTGISSGLIAGSSIQNPKVSLEPLPARLLQQGLQRSSQIHTSSSSQTHVSSSSQAQIAASSHALGTSEAQDASSLTQVTKVHQHSAVQQNYVSPLQATISKSQTNPVVKLSNNPQLSCSSSLIKTSDKPLMYRLPLSTPSPGNGSQGSHPLVSRTVPSTTTSSNYLAKAMVSQISTQGFKSPFSMAASPKLAASPKPATSPKPLPSPKPSASPKPSLSAKPSVSTKLISKSNPTPKPTVSPSSSSPNALVAQGSHSSTNSPVHKQPSGMNISRQSPTLNLLPSSRTSGLPPTKNLQAPSKLTNSSSTGTVGKNSLSGIAMNVPASRGSNLNSSGANRTSLSGGTGSGTQGATKPLSTPHRPSTASGSSVVTASVQSTAGASLLANASPLTLMTSPLSVTNQNVTPFGMLGGLVPVTMPFQFPLEIFGFGTDTAGVTTTSGSTSAAFHHSLTQNLLKGLQPGGAQHAATLSHSPLPAHLQQAFHDGGQSKGDTKLPRKSQ

SEQ ID NO: 763644 - protein, 1076 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGWVFCSLLLSLAGLLPGDPTELFHRTADRPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763645 - protein, 1047 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763646 - protein, 493 aa, Homo sapiens
MLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763647 - protein, 493 aa, Homo sapiens; identical to SEQ ID NO: 763646

SEQ ID NO: 763648 - protein, 643 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSSLKYYSLPAAFPDPQITPREN

SEQ ID NO: 763649 - protein, 235 aa, Homo sapiens [sequence omitted]

SEQ ID NO: 763650 - protein, 1047 aa, Homo sapiens; identical to SEQ ID NO: 763645

SEQ ID NO: 763651 - protein, 1047 aa, Homo sapiens; identical to SEQ ID NO: 763645

SEQ ID NO: 763652 - protein, 567 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIVCMDLYTLGIFCLPYYRETCDMIDFVKNL

SEQ ID NO: 763653 - protein, 190 aa, Homo sapiens
MLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEAFIQMKIKTDAAEAALIIVEHYNPAL

SEQ ID NO: 763654 - protein, 474 aa, Homo sapiens
MNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763655 - protein, 390 aa, Homo sapiens
AESFQVSMSIAAALELTGRSQFLQTHGRITWHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763656 - protein, 235 aa, Homo sapiens [sequence omitted]

SEQ ID NO: 763657 - protein, 317 aa, Homo sapiens
VSSQVHNNKKTQTQTRWVGILLPPSLLGRAPSRGSHGLFHRTADRPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 763658 - protein, 1047 aa, Homo sapiens; identical to SEQ ID NO: 763645

SEQ ID NO: 763659 - protein, 744 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEAFIQMKIKTDAAEAALIIVEHYNPAL

SEQ ID NO: 763660 - protein, 189 aa, Homo sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 763661 - protein, 109 aa, Homo sapiens
GRSQTRQETETRGPHTRRKNPVQRVPAGSHRGREGAPGRVGGCVLRLSRGSWPRDRMCAGVEQEVPGMMGKREQVTGGRSKYWGLHWDSRGLGQARSACRLPSLAPSLG

SEQ ID NO: 763662 - protein, 187 aa, Homo sapiens
MIFCPTATAVPGVVPPPRGVFVVICVGDISLLPSLFLLSPRGLFLFWGPRLFVPTSVQCGRFVGPPRRRNTMLFYRKRFFEGPLTAPAPRLFLFCFFFFFFAFPTLFRKTNPGPSAPCTLPDPSHNLNNLETELEGGDRRGWGHGGRRKRAHYSRRSAPFLSSFSWPPASYRARQHASWPWDLDLFF

SEQ ID NO: 763663 - protein, 275 aa, Homo sapiens
MIFCPTATAVPGVVPPPRGVFVVICVGDISLLPSLFLLSPRGLFLFWGPRLFVPTSVQCGRFVGPPRRRNTMLFYRKRFFEGPLTAPAPRLFLFCFFFFFFAFPTLFRKTNPGPSAPCTLPDPSHNLNNLETELEGGDRRGWGHGGRRKRAHYSRRSAPFLSSFSWPPASYRARQHASWPWDPQPLPGPLGPQGRWRKLQCHWPGPARLRPCRWGSFSTLEFMAAAGRGRVPPAPFLRSSVRRPGRGPNCCRCGPGEAPAAPLRSPLPLTSAAHS

SEQ ID NO: 763664 - protein, 173 aa, Homo sapiens
MIFCPTATAVPGVVPPPRGVFVVICVGDISLLPSLFLLSPRGLFLFWGPRLFVPTSVQCGRFVGPPRRRNTMLFYRKRFFEGPLTAPAPRLFLFCFFFFFFAFPTLFRKTNPGPSAPCTLPDPSHNLNNLETELEGGDRRGWGHGGRRKRAHYSRRSAPFLSRRRIEVVVGGR

SEQ ID NO: 763665 - protein, 213 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763666 - protein, 213 aa, Homo sapiens; identical to SEQ ID NO: 763665

SEQ ID NO: 763667 - protein, 247 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLGRRRGAGQEDGRGIWPAQGDGGPLLRAPNSLCFCIGSVGLFRMGLWVTAPIALLKSLISVIHLITAARNMAALDAADRAKKK

SEQ ID NO: 763668 - protein, 213 aa, Homo sapiens; identical to SEQ ID NO: 763665

SEQ ID NO: 763669 - protein, 213 aa, Homo sapiens; identical to SEQ ID NO: 763665

SEQ ID NO: 763670 - protein, 213 aa, Homo sapiens; identical to SEQ ID NO: 763665

SEQ ID NO: 763671 - protein, 168 aa, Homo sapiens
MPDENIFLFVPNLIGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763672 - protein, 184 aa, Homo sapiens
MPDENIFLFVPNLIGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763673 - protein, 362 aa, Homo sapiens
GGGRKRERKPTGLKGAATIFLSHFFLSPILQRRARRRRFPEATRSWSSGDRSWRPGAPAGLDMSAEGSVCSAYVKRRRNLTRLPHWRSLLLLLCVGLCPTRLPVSSMTDAFRQSLRAPMRFGAQVWVLRMWTATRCVAEPALSCLCAWYGLMAACCERAWDEPLASPEQARGSKGGAAMPDENIFLFVPNLIGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763674 - protein, 271 aa, Homo sapiens
MLSRTEFIGACAVRSMLLVRGLSARWDLVIKMVSSDAVRCLEGSSCRMSETDSIFLFRAPNVVVLCSGIVFRTVYFVFVHVYASLSSCYGASILSYLVLGHSLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763675 - protein, 112 aa, Homo sapiens
MPGLSSPSFLSTSCPAAPSRPPPSTCSAACWTLSMDTPALFTLCAGNELFYCLLYLFHFSEGPLVGSVGLFRMGLWVTAPIALLKSLISVIHLITAARNMAALDAADRAKKK

SEQ ID NO: 763676 - protein, 110 aa, Homo sapiens
PRLRGERDVRWSPGSWLPTCPGSLAVPHSSPPPARRSQSHAFLMCCSTCWDGGQPLFGDVTFSGILRTRASNQGGYAGGPLHPGGAPGVPGPGSVTPCLLSPGVRDARDA

SEQ ID NO: 763677 - protein, 187 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFPSCHPCSCGVPTAHLFDVTDCLHVFIFLIFSTLTRM

SEQ ID NO: 763678 - protein, 106 aa, Homo sapiens
MRERDPVCKKEKKIREVICRDCAFISAGGAGGGTRLPLANVACLLCVQPALFTLCAGNELFPSFGPQTPSALHPIALLKSLISVIHLITAARNMAALDAADRAKKK

SEQ ID NO: 763679 - protein, 139 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRL

SEQ ID NO: 763680 - protein, 252 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITPLFGDVTFSGILRTRASNQGGYAGGPLHPGGAPGVPGPGSVTPCLLSPGVRDARDA

SEQ ID NO: 763681 - protein, 213 aa, Homo sapiens; identical to SEQ ID NO: 763665

SEQ ID NO: 763682 - protein, 157 aa, Homo sapiens
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRLALWDCSGWASGSLPPSPC

SEQ ID NO: 763683 - protein, 185 aa, Homo sapiens
MPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763684 - protein, 122 aa, Homo sapiens
MRIGCMVVVMPLGSPVFSPSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763685 - protein, 123 aa, Homo sapiens
KHRIPGQVDHLVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763686 - protein, 103 aa, Homo sapiens
SATEVKGGSHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 763687 - protein, 131 aa, Homo sapiens
INFHRRKERRKGGRKENREPRERREKIRKKKEREKGRTWILFVACAEDYISLLQLSSTLKNKEDRGKASGPHHPLQADCFLLQALEHLPESFLGQWEPGLAQSQAGEKYEEMEKALSKEQSSTFTPQVRQL

SEQ ID NO: 763688 - protein, 180 aa, Homo sapiens
INFHRRKERRKGGRKENREPRERREKIRKKKEREKGRTWILFVACAEDYISLLQLSSTLKNKEDRGKASGPHHPLQADCFLLQALEHLPESFLGQWEPGLAQSQAGEKYEEMEKALSKEQSSTFTPQTESHSVSQAGVQWCDLGSPQSPPLGFTPFSCLNLQSSWDYRFLPPRPANSLYF

SEQ ID NO: 763689 - protein, 77 aa, Homo sapiens
EARYEAGCVQLPAALSSAGWHSARGKAEQVCEAKCLRGAPRGENPEEKETARIGPAGKRRDGAAYAEWRGRPPFGRR

SEQ ID NO: 763690 - protein, 111 aa, Homo sapiens
MANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 763691 - protein, 77 aa, Homo sapiens; identical to SEQ ID NO: 763689

SEQ ID NO: 763692 - protein, 141 aa, Homo sapiens
DRLCALGHLMQTGVGRLFFARAYGGGGWGGRGRSCCTGRPSWGASSVVTRGPHVTQSCRATQPSVQSSLASGYQLPAALSSAGWHSARGKAEQVCEAKCLRGAPRGENPEEKETARIGPAGKRRDGAAYAEWRGRPPFGRR

SEQ ID NO: 763693 - protein, 88 aa, Homo sapiens
SLPPLIHLQPSVQSSLASGYQLPAALSSAGWHSARGKAEQVCEAKCLRGAPRGENPEEKETARIGPAGKRRDGAAYAEWRGRPPFGRR

SEQ ID NO: 763694 - protein, 111 aa, Homo sapiens; identical to SEQ ID NO: 763690

SEQ ID NO: 763695 - protein, 111 aa, Homo sapiens; identical to SEQ ID NO: 763690

SEQ ID NO: 763696 - protein, 179 aa, Homo sapiens
KRAHRRHGKVTGVTTASQSPVVIGEAAAFGAVVTRVWLPAPRCPELGGLAFGPGKSGAEKQPEKKNLIMANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 763697 - protein, 141 aa, Homo sapiens; identical to SEQ ID NO: 763692

SEQ ID NO: 763698 - protein, 141 aa, Homo sapiens; identical to SEQ ID NO: 763692

SEQ ID NO: 763699 - protein, 141 aa, Homo sapiens; identical to SEQ ID NO: 763692

SEQ ID NO: 763700 - protein, 141 aa, Homo sapiens; identical to SEQ ID NO: 763692

SEQ ID NO: 763701 - protein, 111 aa, Homo sapiens; identical to SEQ ID NO: 763690

SEQ ID NO: 763702 - protein, 80 aa, Homo sapiens
PPPPPPDSRLGYQLPAALSSAGWHSARGKAEQVCEAKCLRGAPRGENPEEKETARIGPAGKRRDGAAYAEWRGRPPFGRR

SEQ ID NO: 763703 - protein, 80 aa, Homo sapiens; identical to SEQ ID NO: 763702

SEQ ID NO: 763704 - protein, 106 aa, Homo sapiens
KRAHRRHGKVTGVTTASRAPWLSARRQPSVQSSLASGYQLPAALSSAGWHSARGKAEQVCEAKCLRGAPRGENPEEKETARIGPAGKRRDGAAYAEWRGRPPFGRR

SEQ ID NO: 763705 - protein, 141 aa, Homo sapiens; identical to SEQ ID NO: 763692

SEQ ID NO: 763706 - protein, 111 aa, Homo sapiens; identical to SEQ ID NO: 763690

SEQ ID NO: 763707 - protein, 2871 aa, Homo sapiens
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 763708 - protein, 2723 aa, Homo sapiens
MRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 763709 - protein, 2694 aa, Homo sapiens
RSRGSRGVVVISEGLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 763710 - protein, 1142 aa, Homo sapiens
PPVLPVRARSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 763711 - protein, 2089 aa, Homo sapiens
MLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 763712 - protein, 83 aa, Homo sapiens
TPLRQRPPRRWGQRGWSLAPARGPRGRRCPSCSPCALSLTSPGSCLLKTPVFTPYKASSEQTGRPLVEPAHPVPSAWRPGPRA

SEQ ID NO: 763713 - protein, 248 aa, Homo sapiens
HEGDAPSSRCPSAAAAAHRAPHGPSRPERAPPLTARAPGRKNTRSRPYLRVSSDPWRSHCGSRAIAMEFVMKQALGGATKDMGKMLGGDEEKDRRLPHPARGARPQDPPSPPRAPLPAGGWSPIAWDAPFSCCLPPTQQRPRPGLDRRRGRPPAKAPPVATRFSELWLGPTLVGDHVCLQGRSTSLHMTTTAVGVLAVWPRGRWRPGGGRLGGPLPSLRNRGGLPGGVAGVLGSRTIERYLRRSRHRP

SEQ ID NO: 763714 - protein, 302 aa, Homo sapiens
SRKMGASPSLLPPMSAPGPHSPWGLPIPPGTPRVRHQEEGGARGRGPGRHGGQLRGELDAAQEGHPAGLRGRGGGGGREHPGHRHQVPARAAAGHAQEVAPRGTAAPRSPRPSPYRSSAEAPEGRAERSPHADISHSPRPALPAPAASLTRQGARAPRTPPVRPVLLCPRVAGAPSPGTPLSLAVYRPPSSARGQGRRRAAPRPPLCARSRRWAPVGPALRSTAIADGGVRAGRGRRGLGPPPARGLRGSDRSAVSICVRTRPLSAPRPGPLAPLSIRLCPRPFLSSLEGFASYERHGRVHF

SEQ ID NO: 763715 - protein, 193 aa, Homo sapiens
HEGDAPSSRCPSAAAAAHRAPHGPSRPERAPPLTARAPGRKNTRSRPYLRVSSDPWRSHCGSRAIAMEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGS

SEQ ID NO: 763716 - protein, 200 aa, Homo sapiens
HEGDAPSSRCPSAAAAAHRAPHGPSRPERAPPLTARAPGRKNTRSRPYLRVSSDPWRSHCGSRAIAMEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 763717 - protein, 200 aa, Homo sapiens; identical to SEQ ID NO: 763716

SEQ ID NO: 763718 - protein, 145 aa, Homo sapiens
SRLTTARAVSGTLQALPEPPQGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 763719 - protein, 200 aa, Homo sapiens; identical to SEQ ID NO: 763716

SEQ ID NO: 763720 - protein, 114 aa, Homo sapiens
MHQVSTCFGPGRGLALTFMTLHSFREAITLDCNTNDRRPSGQRPPRPSAPQRRGPRGRRCPSCSPCALSLTSPGSCLLKTPVFTPYKASSEQTGRPLVEPAHPVPSAWRPGPRA

SEQ ID NO: 763721 - protein, 200 aa, Homo sapiens; identical to SEQ ID NO: 763716

SEQ ID NO: 763722 - protein, 147 aa, Homo sapiens
RRGRGSSSRLHRAGGERVHREPAAVVPQPGDVRHQWFFQRGLSSPKQEAVFLLCVQPRPLEGLRVGAESSWGQGPPTRPPMSPRGPPSQCEDHSPMKTDPVGSPLSEFRRCPFLEQEQAKKYSCNMMAFLADEYCNYCRDILRNVRN

SEQ ID NO: 763723 - protein, 139 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLTVWMASFSPVSESSD

SEQ ID NO: 763724 - protein, 511 aa, Homo sapiens
GVKGSGGHRGGGEMAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQTEAASWPWGRGLGCGAVWVLSSSPLPRPSLSNPAWDLGFNAEAMSLSGPASGYSHPGTEKAADGDCLPQPQQHLGLQLLESYHPRRQAQPGRGEEWAVKMKPHAQSPPIPHAAPPQSQATSCLLLVGGGLLSPSSLTFNLTLTLHRAPTLHPSWKAGLMASHWPPPPDQSVLFRGL

SEQ ID NO: 763725 - protein, 110 aa, Homo sapiens
CFFAVGTPYYMSPERIHENGYNFKSDIWSLGCLLYEMAALQSPFYGDKMNLYSLCKKIEQCDYPPLPSDHYSEELRQLVNMCINPDPEKRPDVTYVYDVAKRMHACTASS

SEQ ID NO: 763726 - protein, 110 aa, Homo sapiens; identical to SEQ ID NO: 763725

SEQ ID NO: 763727 - protein, 110 aa, Homo sapiens; identical to SEQ ID NO: 763725

SEQ ID NO: 763728 - protein, 110 aa, Homo sapiens; identical to SEQ ID NO: 763725

SEQ ID NO: 763729 - protein, 110 aa, Homo sapiens; identical to SEQ ID NO: 763725

SEQ ID NO: 763730 - protein, 110 aa, Homo sapiens; identical to SEQ ID NO: 763725

SEQ ID NO: 763731 - protein, 110 aa, Homo sapiens; identical to SEQ ID NO: 763725

SEQ ID NO: 763732 - protein, 117 aa, Homo sapiens
RYPSALPCLSALPCLSALPCLPYIPVLIFLSSKGLMADSDKVEPSSALPCLPAIVLDMRRPLVMEGRGSGSPPMPVCAWFQHHSPYFLKQLNPTIPPSQPISILELFLLLNRAVSVN

SEQ ID NO: 763733 - protein, 131 aa, Homo sapiens
PQSRGKQRWEIPTANLTFPTPGWQPTASIIPGFAQFPSTPCSSVSAGPNMSGSPLPGTPGLPDKHLLLLAGSPFLWVTLLSLPKRPDTIPPPTAFTTSGGSSLHSSLTACVSWENTSSSRAEAVLHSSPQP

SEQ ID NO: 763734 - protein, 138 aa, Homo sapiens
MPAAFPCVFPPQSLQVFPQMIVKVWEKQSLPLPGLRGSPVERLYLPRNELDNPHKQKAWKIYPPEFAVEILFGMVSVDSLLFVLSSPHWWLHLAQGSFWMSEGGFSLCHPGWSVVAQSLLTSTSAFCVRAILLPQPPE

SEQ ID NO: 763735 - protein, 114 aa, Homo sapiens
MPAAFPCVFPPQSLQVFPQMIVKVWEKQSLPLPGLRGSPVERKNRNYGLCLPYCLQNIFNCRGFIYQEMNWIIHINKKLGKFIHQNLPWRYFLEPGLPVYHPSVDTLGTGHACG

SEQ ID NO: 763736 - protein, 87 aa, Homo sapiens
SSVPMPEPVPPPSECVSWKPCRQSQCSHSFRTTSQHCVHHVRALRVVPFRPVVPCTRLACNKESPVPFKQESVRHHHAVVTDKEGVK

SEQ ID NO: 763737 - protein, 225 aa, Homo sapiens
MASLPPFGGPLADATPLTEAESTHPPIHSLAFITPRAPHRAPHDTPPSTPRYSGLSPTKHSPCTGMPDPPPPRPAPVPPPPLLSPTAPLPTIPPPTQFHPRARVMSPPGRFPRPHRHSHPSTAPPPPSRHHSHSLCPPPSIDGHATHQTPNRQGYDIGQSKPSASIVPETCPDTLPHTLPPRAKYALHQFLSFVRTPPPPSPQAFIPRTIAIPSTKSPAAPSPID

SEQ ID NO: 763738 - protein, 154 aa, Homo sapiens
MVYGSIHPSRHCIPTAQSLLFTSGWLDFSFIDTFATTSPVTRLNELSFHADNSSNSLTSVPCSLHSIYIYLLLNMTSSTDSHSQTPDQNSPLLKCHALVTLTCPSSFVMTTQLFIFPRGASPFSTPSLSFSPLYLSSLSQSKQDYVAFQLRHSC

SEQ ID NO: 763739 - protein, 622 aa, Homo sapiens
MVDVVGLERETGPRGSPWPGLPLPSLVGPAPLLTCLCPQCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 763740 - protein, 647 aa, Homo sapiens [sequence omitted]

SEQ ID NO: 763741 - protein, 178 aa, Homo sapiens
RAGLTQGSSQVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLS

SEQ ID NO: 763742 - protein, 578 aa, Homo sapiens
ALPAGSKGPWANSRRRRRLVAVPGHPDPPHRPEPTLLLMGAPGSAGGVLAALLDHVRSGSCFHALPSPQYFVDFVFQQHSSEVPMTLAGEAWAGLWRGAPPIPQPPRPWGAGPEPTQTRGANFFSLPELSALMQRLGVGREAHSDHSHRHRGASSRDPVPLISSSNSSSVWDTVSCALGEDGASPGSAWAPEPVLPPPKVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 763743 - protein, 180 aa, Homo sapiens
TEEVASTAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 763744 - protein, 647 aa, Homo sapiens [sequence omitted]

SEQ ID NO: 763745 - protein, 627 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMVRMARGGAALGRELSRGAEQGR

SEQ ID NO: 763746 - protein, 625 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLFLLHNVGLLGGWTVLLLLSLYEDDITF

SEQ ID NO: 763747 - protein, 641 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLS

SEQ ID NO: 763748 - protein, 72 aa, Homo sapiens
PSVRPRVRGRVAWILAVATGLFLYVALCDMLPAMLKVRDPRPWLLFLLHNVGLLGGWTVLLLLSLYEDDITF

SEQ ID NO: 763749 - protein, 647 aa, Homo sapiens [sequence omitted]

SEQ ID NO: 763750 - protein, 184 aa, Homo sapiens
RAGLTQGSSQVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 763751 - protein, 149 aa, Homo sapiens
MITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 763752 - protein, 601 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVSCALGKMGPHRGLLGPLSLSCHPQVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPGDFAALLHAGLSVRQALLLNLASALTAFAGLYVALAVGVSEESEAWILAVATGLFLYVALCDMVRMARGGAALGRELSRGAEQGR

SEQ ID NO: 763753 - protein, 647 aa, Homo sapiens [sequence omitted]

SEQ ID NO: 763754 - protein, 376 aa, Homo sapiens
IPRALLAYCKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLASRDLQKSTNGIWTFVDLDLCHMEVLGWDLNATCSASWVLTISKMLSLSQGFLIHAFYSWKIG

SEQ ID NO: 763755 - protein, 482 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELTFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLASRDLQKSTNGIWTFVDLDLCHMEVLGWDLNATCSASWVLTISKMLSLSQGFLIHAFYSWKIG

SEQ ID NO: 763756 - protein, 333 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELTFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 763757 - protein, 477 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELTFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 763758 - protein, 213 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELTFGSSVEVQGQLIKSPSKRQNVELKAEKRHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGL

SEQ ID NO: 763759 - protein, 151 aa, Homo sapiens
SSLPFPFRSIYITGSSWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 763760 - protein, 156 aa, Homo sapiens
LKLSRPQFLRNSKSTFWGADLRTEHEKYLVKHCGNIPVFVINYPLTLKPFYMRDNEDGPQHTVAAVDLLVPGVGELFGGGLREERYHFLEERLASRDLQKSTNGIWTFVDLDLCHMEVLGWDLNATCSASWVLTISKMLSLSQGFLIHAFYSWKIG

SEQ ID NO: 763761 - protein, 477 aa, Homo sapiens; identical to SEQ ID NO: 763757

SEQ ID NO: 763762 - protein, 445 aa, Homo sapiens
LLPRSVRRKRRWRGEGWIRSVRSQKEVLFLHVNDGSSLESLQVVADSGLDSRELTFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 763763 - protein, 482 aa, Homo sapiens; identical to SEQ ID NO: 763755

SEQ ID NO: 763764 - protein, 150 aa, Homo sapiens
MPDLHGLPQRWGADLRTEHEKYLVKHCGNIPVFVINYPLTLKPFYMRDNEDGPQHTVAAVDLLVPGVGELFGGGLREERYHFLEERLASRDLQKSTNGIWTFVDLDLCHMEVLGWDLNATCSASWVLTISKMLSLSQGFLIHAFYSWKIG

SEQ ID NO: 763765 - protein, 187 aa, Homo sapiens
SLYLLFLLPGILLPRYFYGSFPYSVISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLASRDLQKSTNGIWTFVDLDLCHMEVLGWDLNATCSASWVLTISKMLSLSQGFLIHAFYSWKIG

SEQ ID NO: 763766 - protein, 148 aa, Homo sapiens
ICHGTPEGLCTCSRPQETQGHDLASVPTPMAIGLTYTIPGYHSFSSKEGESTQNEHQDVSSHHGDAQAETRRRCSQAWGRGWRRSSGTSSALRFCDSAFVLCSPFCDSAFGSHIVSSCKALGKKCYPTVCCHTKTFITQCFANIRLCG

SEQ ID NO: 763767 - protein, 248 aa, Homo sapiens
NSTRKSSQEEGLILGSRKYQHSQRKTIKTYLQELCNSNRKEKQWCVPMWDIKSRGSGGSTPAPPSHLLLYLLHPQSTRTMGCCGCSGGCGSSCGGCDSSCGSCGSGCRGCGPSCCAPVYCCKPVCCCVPACSCSSCGKRGCGSCGGSKGGCGSCGCSQCSCCKPCCCSSGCGSSCCQCSCCKPYCSQCSCCKPCCSSSGRGSSCCQSSCCKPCCSSSGCGSSCCQSSCCKPCCSQSRCCVPVCYQCKI

SEQ ID NO: 763768 - protein, 122 aa, Homo sapiens [sequence omitted]

SEQ ID NO: 763769 - protein, 251 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 763770 - protein, 111 aa, Homo sapiens
FTTFPLPRHWCLQKLVVVHLVQLQPCTEPVPVAAHPAAAAGVPGWAQWLEPALTCSRTPHQPMPGSPLAGVGSGPAAQDEHSLLGRVGRMSPAGMSKTPAEALQAMEVSSW

SEQ ID NO: 763771 - protein, 251 aa, Homo sapiens; identical to SEQ ID NO: 763769

SEQ ID NO: 763772 - protein, 224 aa, Homo sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 763773 - protein, 128 aa, Homo sapiens
GGWVTPQESAPGRGRAAPPRPTPLGVGTSRESPAEARRSSARRGGRSEPGRAAGGGAAEDTRRRAGDMDRGEQGRRRNPDSVSSVSSKREASSRDQAETWNQFSTGTKTEHCQRVARRDSNICLQEDI

SEQ ID NO: 763774 - protein, 185 aa, Homo sapiens
MALNPQPGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 763775 - protein, 178 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 763776 - protein, 251 aa, Homo sapiens; identical to SEQ ID NO: 763769

SEQ ID NO: 763777 - protein, 251 aa, Homo sapiens; identical to SEQ ID NO: 763769

SEQ ID NO: 763778 - protein, 274 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 763779 - protein, 237 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKAHPWQVWDLGQQHKMSTAYWAEWAE

SEQ ID NO: 763780 - protein, 251 aa, Homo sapiens; identical to SEQ ID NO: 763769

SEQ ID NO: 763781 - protein, 251 aa, Homo sapiens; identical to SEQ ID NO: 763769

SEQ ID NO: 763782 - protein, 251 aa, Homo sapiens; identical to SEQ ID NO: 763769

SEQ ID NO: 763783 - protein, 274 aa, Homo sapiens; identical to SEQ ID NO: 763778

SEQ ID NO: 763784 - protein, 178 aa, Homo sapiens; identical to SEQ ID NO: 763775

SEQ ID NO: 763785 - protein, 251 aa, Homo sapiens; identical to SEQ ID NO: 763769

SEQ ID NO: 763786 - protein, 251 aa, Homo sapiens; identical to SEQ ID NO: 763769

SEQ ID NO: 763787 - protein, 280 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESLPTLPPF

SEQ ID NO: 763788 - protein, 207 aa, Homo sapiens
GGWVTPQESAPGRGRAAPPRPTPLGVGTSRESPAEARRSSARRGGRSEPGRAAGGGAAEDTRRRAGDMDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKYVLIFPCSLSS

SEQ ID NO: 763789 - protein, 443 aa, Homo sapiens
MEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763790 - protein, 501 aa, Homo sapiens
MVLQPSERHYRDWNHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763791 - protein, 509 aa, Homo sapiens
MLLSLPALHLQTSEHHPFFQLPHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763792 - protein, 432 aa, Homo sapiens
MNYPDENTYGNKADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763793 - protein, 432 aa, Homo sapiens; identical to SEQ ID NO: 763792

SEQ ID NO: 763794 - protein, 103 aa, Homo sapiens
RCRSRPPVGPAPSFRPASLNPVPAISPLQLGSRKAPFCRGCPLSQGEEGSFLHFGAAAKEGNLLGISPDPLVSASGAGGRDQTPRGTAYLASFRKYYSSGGYK

SEQ ID NO: 763795 - protein, 443 aa, Homo sapiens; identical to SEQ ID NO: 763789

SEQ ID NO: 763796 - protein, 500 aa, Homo sapiens
LPEPPSRGTSTLIPARLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763797 - protein, 446 aa, Homo sapiens
MKCFSRYLPYIFRPPNTILSSSCHTEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763798 - protein, 423 aa, Homo sapiens
MQNSDIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 763799 - protein, 149 aa, Homo sapiens
MGSHVAVFDDVIKVFSDMKVCKSSTLEKVKKRKKLLLFCLSEYKKYIILAEAKKILVSNVDQTIDDPYATFVKMLTVKDCRYAPYDATKDSKKKDLVFIFWASESASIKSKMIYASSKDVIKKQLGVSTVVFLEGKLCDPLQRPSWRIY

SEQ ID NO: 763800 - protein, 599 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763801 - protein, 107 aa, Homo sapiens
MLLPALCAWLLWVPWCLLVAGSGRSGGELCCSSYGVSVISVWSKCSVCRCLMGSVPRIFFAFYPIAWLPLPGSQGCWSRSWSGLWWSLHLVSSASALHLVYFRAWWQ

SEQ ID NO: 763802 - protein, 73 aa, Homo sapiens
RTQKTEDCIAVNTDTMADNPNHCNCIIDQIFTGGLQSDVTCQVCQEVRGCVLGNIKPSGAVLTSSQSPELCVL

SEQ ID NO: 763803 - protein, 488 aa, Homo sapiens
CPAAWGAWDFGGRSRAFLREAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763804 - protein, 449 aa, Homo sapiens
SSGYPGGYRRPGLARACERRSGSTCAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763805 - protein, 440 aa, Homo sapiens
VYRRYLRVRRRSGTILAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763806 - protein, 339 aa, Homo sapiens [sequence omitted]

SEQ ID NO: 763807 - protein, 276 aa, Homo sapiens
MFVYSAIRVRPRGRTRIWGDTNPRAVVLSPGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763808 - protein, 375 aa, Homo sapiens
MCGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEWSLHHHRPLLGHQLGSPRLFHPILAPEPRERGQRGKRGKPRVGNHHAHGLPATIHQTRALGQQRQDQVQRLP

SEQ ID NO: 763809 - protein, 599 aa, Homo sapiens; identical to SEQ ID NO: 763800

SEQ ID NO: 763810 - protein, 599 aa, Homo sapiens; identical to SEQ ID NO: 763800

SEQ ID NO: 763811 - protein, 182 aa, Homo sapiens
WYNDVYVVDHYAVVLLIKLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763812 - protein, 76 aa, Homo sapiens
VADLEDPSDHDNKYSLFAVVNHQGTLESGHYTSFIRQHKDQWFKCDDAIITKASIKDVLDSEGYLLFYHKQFLEYE

SEQ ID NO: 763813 - protein, 134 aa, Homo sapiens
RRVCTRRTILRAYDNSRRPSPVSAMSVASTSTGCIPASTVSSSAVSQRSIFTSMRRRSGTTWHTDGEAPGAALKMDEMRGVLWVGGAAYTRHQNISCVMTWGCNGGLTAQSDRCLAFPSTRCGKAPTCCKIMGP

SEQ ID NO: 763814 - protein, 107 aa, Homo sapiens; identical to SEQ ID NO: 763801

SEQ ID NO: 763815 - protein, 107 aa, Homo sapiens; identical to SEQ ID NO: 763801

SEQ ID NO: 763816 - protein, 599 aa, Homo sapiens; identical to SEQ ID NO: 763800

SEQ ID NO: 763817 - protein, 599 aa, Homo sapiens; identical to SEQ ID NO: 763800

SEQ ID NO: 763818 - protein, 599 aa, Homo sapiens; identical to SEQ ID NO: 763800

SEQ ID NO: 763819 - protein, 407 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNLHLLGSSSSRAAASQVAGTTGMHHHARLIFVFLVEMGFHHVSNS

SEQ ID NO: 763820 - protein, 599 aa, Homo sapiens; identical to SEQ ID NO: 763800

SEQ ID NO: 763821 - protein, 599 aa, Homo sapiens; identical to SEQ ID NO: 763800

SEQ ID NO: 763822 - protein, 599 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGQLRVPRSTSASRA

SEQ ID NO: 763823 - protein, 594 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGHTRRRFPP

SEQ ID NO: 763824 - protein, 557 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFVGSTLFVEVALLFVEVA

SEQ ID NO: 763825 - protein, 498 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITT

SEQ ID NO: 763826 - protein, 389 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCQ

SEQ ID NO: 763827 - protein, 374 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGRSTTTPTTSPRAVQRS

SEQ ID NO: 763828 - protein, 213 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLGEASFWDGGIVVAPKLLLFDFLICSSTLPKVHFVVCLK

SEQ ID NO: 763829 - protein, 237 aa, Homo sapiens
QHRLDEPRGIGRGTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763830 - protein, 101 aa, Homo sapiens
QAWGLVYVAQAGLEPMGSSNPPSLASQVAGTTGMGHRAWLCSLLQLKFKNPGHDPPKLFQNPKWTVTSKLHKTSKYRERPVLPVSRGPFSIRSIDRLGPCL

SEQ ID NO: 763831 - protein, 367 aa, Homo sapiens
VYRRYLRVRRRSGTILAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSNNHSNLSGTSSLDLPGSFTQFWPLTKNKAHVQQGKAHVGIHEHRKPRRIQNQTVGQQGPETCRAVTKYSEPNSSIVRRSTDRYHTKKNPSIGGKQQCNPRRYTEHTKSRANNSRTDVDSTARSSDMCVDKYTLQ

SEQ ID NO: 763832 - protein, 478 aa, Homo sapiens
NQGRGEVVGLDRESVSGCCAVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763833 - protein, 185 aa, Homo sapiens
EDPPLYFNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763834 - protein, 128 aa, Homo sapiens
MKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 763835 - protein, 237 aa, Homo sapiens; identical to SEQ ID NO: 763829

SEQ ID NO: 763836 - protein, 128 aa, Homo sapiens; identical to SEQ ID NO: 763834

SEQ ID NO: 763837 - protein, 107 aa, Homo sapiens; identical to SEQ ID NO: 763801

SEQ ID NO: 763838 - protein, 107 aa, Homo sapiens; identical to SEQ ID NO: 763801

SEQ ID NO: 763839 - protein, 72 aa, Homo sapiens
SVSTALWDCRELILPPLVFSLPSIPLPGYRCLAAKGVGREAGVASGGACILSRLPLLYIWCTFGRGGSKMTP

SEQ ID NO: 763840 - protein, 599 aa, Homo sapiens; identical to SEQ ID NO: 763800

SEQ ID NO: 763841 - protein, 599 aa, Homo sapiens; identical to SEQ ID NO: 763800

SEQ ID NO: 763842 - protein, 599 aa, Homo sapiens; identical to SEQ ID NO: 763800

SEQ ID NO: 763843 - protein, 599 aa, Homo sapiens; identical to SEQ ID NO: 763800

SEQ ID NO: 763844 - protein, 599 aa, Homo sapiens; identical to SEQ ID NO: 763800

SEQ ID NO: 763845 - protein, 519 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASRYVGL

SEQ ID NO: 763846 - protein, 590 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSRESRMSGPVTSSPRNSLSMTQYFLFAVVNHPGLGGVAYPGFPGPRPGQCAVPLPGGRGLRGCGLNVGRPLGARSC

SEQ ID NO: 763847 - protein, 487 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRRY

SEQ ID NO: 763848 - protein, 263 aa, Homo sapiens
AECGPQQPQLGGGACLAASPRRSRSPIFVRPPRFVLGARALASLASRRAAPTPRWRRPRLPRRRPPRAGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGGWSVSSLSARLLSRV

SEQ ID NO: 763849 - protein, 46 aa, Homo sapiens
MYGGIYCFLCQDYIYDKDMEIIAKEEQRKAWKMQGLVPPQFTCLIL

SEQ ID NO: 763850 - protein, 147 aa, Homo sapiens
MPPPQKIPSVRPFKQRKSLAIRQEEVAGIRAKFPNKIPVVVERYPRETFLPPLDKTKFLVPQELTMTQFLSIIRSRMVLRATEAFYLLVNNKSLVSMSATMAEIYRDYKDEDGFVYMTYASQETFGCLESAAPRDGSSLEDRPCNPL

SEQ ID NO: 763851 - protein, 115 aa, Homo sapiens
MPPPQKIPSVRPFKQRKSLAIRQEEVAGIRAKFPNKIPVVVERYPRETFLPPLDKTKFLVPQELTMTQFLSIIRSRMVLRATEAFYLLVNNKSLVSMSATMAEIYRDASSHITVF

SEQ ID NO: 763852 - protein, 417 aa, Homo sapiens
QNVLCGCGETLRRGLRCVVGTHKTDVKMMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSVSMKSLIIYRLQSYKCMEENKMTIKVQAAIGSPVAPFISPYPPIQTPLRKECYVI

SEQ ID NO: 763853 - protein, 414 aa, Homo sapiens
MSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 763854 - protein, 245 aa, Homo sapiens
LIQSALYPQEYILKGSGQQPWPGNGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 763855 - protein, 581 aa, Homo sapiens
QNVLCGCGETLRRGLRCVVGTHKTDVKMMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 763856 - protein, 298 aa, Homo sapiens
QNVLCGCGETLRRGLRCVVGTHKTDVKMMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVNNDFPS

SEQ ID NO: 763857 - protein, 190 aa, Homo sapiens
QNVLCGCGETLRRGLRCVVGTHKTDVKMMLSRAKPAVGRGVQHTDKRKKKGRKIPKLEELLSKRDFTGAITLLEFKRHVGEEEEDTNLWIGYCAFHLGDYKRALERIQKCYSREKELMGYTGGANEARSKMDVAQTKLDIYLSRHNTAVSQLTKAKEALIAASETLKERKAAIRDIEGKLPQTEQELKEK

SEQ ID NO: 763858 - protein, 392 aa, Homo sapiens
PWKLLPQTCRCCYCCPCCGQVSGCGERGVGLGRADPRFPTGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKNSKLHGPTETSSCSGAAPTVEMDEELHYASLNFHGMNPSKDTSTEYSEVRTQ

SEQ ID NO: 763859 - protein, 371 aa, Homo sapiens
LEAASSDMPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKNSKLHGPTETSSCSGAAPTVEMDEELHYASLNFHGMNPSKDTSTEYSEVRTQ

SEQ ID NO: 763860 - protein, 237 aa, Homo sapiens
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKNSKLHGPTETSSCSGAAPTVEMDEELHYASLNFHGMNPSKDTSTEYSEVRTQ

SEQ ID NO: 763861 - protein, 292 aa, Homo sapiens
MSHLSQQKIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 763862 - protein, 292 aa, Homo sapiens; identical to SEQ ID NO: 763861

SEQ ID NO: 763863 - protein, 292 aa, Homo sapiens; identical to SEQ ID NO: 763861

SEQ ID NO: 763864 - protein, 292 aa, Homo sapiens; identical to SEQ ID NO: 763861

SEQ ID NO: 763865 - protein, 292 aa, Homo sapiens; identical to SEQ ID NO: 763861

SEQ ID NO: 763866 - protein, 292 aa, Homo sapiens; identical to SEQ ID NO: 763861

SEQ ID NO: 763867 - protein, 104 aa, Homo sapiens
MTLPVIIFVCFIILLVSPDSRGARRPSCCCSDVSLPASSVPPLWWLFSFIHIPFPVLTHCPLYFVKPYILSDIQVPFCYYLLSSFLVAECLRIIFYTCSHTSRC

SEQ ID NO: 763868 - protein, 69 aa, Homo sapiens
ECASAAHRVDILVFVRGSVRPLGPRGAKVGGRHRPRSQTSCVNSFLCHFLPWGPQRWGLAMLPRLVLNF

SEQ ID NO: 763869 - protein, 292 aa, Homo sapiens; identical to SEQ ID NO: 763861

SEQ ID NO: 763870 - protein, 292 aa, Homo sapiens; identical to SEQ ID NO: 763861

SEQ ID NO: 763871 - protein, 292 aa, Homo sapiens; identical to SEQ ID NO: 763861

SEQ ID NO: 763872 - protein, 292 aa, Homo sapiens; identical to SEQ ID NO: 763861

SEQ ID NO: 763873 - protein, 1076 aa, Homo sapiens
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLIPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 763874 - protein, 1076 aa, Homo sapiens; identical to SEQ ID NO: 763873

SEQ ID NO: 763875 - protein, 945 aa, Homo sapiens
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLIPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVGNFKSPW

SEQ ID NO: 763876 - protein, 786 aa, Homo sapiens [sequence omitted]

SEQ ID NO: 763877 - protein, 1076 aa, Homo sapiens; identical to SEQ ID NO: 763873

SEQ ID NO: 763878 - protein, 963 aa, Homo sapiens [sequence omitted]

SEQ ID NO: 763879 - protein, 850 aa, Homo sapiens
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLIPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRRNLS

SEQ ID NO: 763880 - protein, 963 aa, Homo sapiens [sequence omitted]

SEQ ID NO: 763881 - protein, 965 aa, Homo sapiens
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLIPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMASIFYIVCFPAKSTNLMTNLSALMQYLKI

SEQ ID NO: 763882 - protein, 585 aa, Homo sapiens
GRAGGRDGAPRGRAWPGCARLGSGRVAGAGVAGERVAAPRVTAPPPPMLLPLACLHGRVAQCLTSLLLLAEPLPRPRRGARARGAASTGAEAAPAAPPAKMAAELYAPASAAAADLANSNAGAAVGRKAGPRSPPSAPAPAPPPPAPAPPTLGNNHQESPGWRCCRPTLRERNALMFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 763883 - protein, 464 aa, Homo sapiens
MFNNELMADVHFVVGPPGATRTVPAHKYVLAVGSSVFYAMFYGDLAEVKSEIHIPDVEPAAFLILLKYSPLYWGGTGGSVLGGLRRLLKGSTQELMDSSPRPSPAMGAWEPAPDAGPASPRYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 763884 - protein, 410 aa, Homo sapiens
MFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 763885 - protein, 585 aa, Homo sapiens; identical to SEQ ID NO: 763882

SEQ ID NO: 763886 - protein, 237 aa, Homo sapiens
ACTIAKFVQTAGWYRSEFRDKDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 763887 - protein, 237 aa, Homo sapiens; identical to SEQ ID NO: 763886

SEQ ID NO: 763888 - protein, 237 aa, Homo sapiens; identical to SEQ ID NO: 763886

SEQ ID NO: 763889 - protein, 302 aa, Homo sapiens
KSLRKMTHIKMCSAKYSASCDKRVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 763890 - protein, 87 aa, Homo sapiens
KISQASVLGLQENDEEAKKIAKEGQLMARDLLQPHRLYCYYYQVLQKYAERQSSKPEVRDGMELVPQPEDSTAICQCHRKKPSREEL

SEQ ID NO: 763891 - protein, 237 aa, Homo sapiens; identical to SEQ ID NO: 763886

SEQ ID NO: 763892 - protein, 206 aa, Homo sapiens
MEVDINGESRSTLTTLPFPGAEANSPGKAEAEKPRCSSTPCSPMRRTVSGYQILHMDSNYLVGFTTGEELLKLAQKCTGGEESKAEAMPSLRSKQLDAGLARSSRLYKTRSRYYQPYEIPAVNGRRRRRMPSSGDKCTKSLPYEPYKALHGPLPLCLLKGKRAHSKSLDYLNLDKMIKEPADTEVLQYQLQHLTLRGDRVFARNNT

SEQ ID NO: 763893 - protein, 206 aa, Homo sapiens; identical to SEQ ID NO: 763892

SEQ ID NO: 763894 - protein, 206 aa, Homo sapiens; identical to SEQ ID NO: 763892

SEQ ID NO: 763895 - protein, 206 aa, Homo sapiens; identical to SEQ ID NO: 763892

SEQ ID NO: 763896 - protein, 206 aa, Homo sapiens; identical to SEQ ID NO: 763892

SEQ ID NO: 763897 - protein, 206 aa, Homo sapiens; identical to SEQ ID NO: 763892

SEQ ID NO: 763898 - protein, 206 aa, Homo sapiens; identical to SEQ ID NO: 763892

SEQ ID NO: 763899 - protein, 206 aa, Homo sapiens; identical to SEQ ID NO: 763892

SEQ ID NO: 763900 - protein, 122 aa, Homo sapiens
GVDEDHCGTWACLCSLPPSHSLEHGWAWDPALTLQVRTMLQAQVEVSQLLTFGAGRFFVVGGSPVHCKTFSSIHVLHSLDTSITAQVMTPKVSPDVAKHTLVGKFTLAENRWPRGRQRNEDS

SEQ ID NO: 763901 - protein, 104 aa, Homo sapiens [sequence omitted]

SEQ ID NO: 763902 - protein, 187 aa, Homo sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 763903 - protein, 88 aa, Homo sapiens
EVALSRWGSQKGDGFPLELGHSTARALLPLPPPNSASSHSHRDSAGVCPVGVLFSCHAPLNILSPSRCLCLLSLMCSSLASTACVFLR

SEQ ID NO: 763904 - protein, 115 aa, Homo sapiens
APGLPLSPRGQSGPKHRCPRSPARQKLGSKPAKCAPAGACAAGPEDSRGRAASAARRKRFMTASDSLQQEYRLQPLSRRTLNTSFHHLVFAVALGKSAESAITLQGELSVLSASF

SEQ ID NO: 763905 - protein, 81 aa, Homo sapiens
LPWSLMTTVHDSVRFSAAGVQVAATLPPNIEYVFPPSCLCCGSGKISRVSHHSPRGAVSSICQLLSVQFDFYLFNLEFECL

SEQ ID NO: 763906 - protein, 613 aa, Homo sapiens
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 763907 - protein, 613 aa, Homo sapiens; identical to SEQ ID NO: 763906

SEQ ID NO: 763908 - protein, 172 aa, Homo sapiens
SCLSLPSSWDYRQSGSSQPEAHPSARASQASTEAPGQQCTQVPGDPTMWSGWWLWPLVAVCTADFFRDEAERIMRDSPVIDGHNDLPWQLLDMFNNRLQDERANLTTLAGTHTNIPKLRAGFVGGQVPPALPCACPVWGHPVSYLRPGYSGTIPVVFLQGPSVPRPREGFPA

SEQ ID NO: 763909 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 763910 - protein, 373 aa, Homo sapiens
SGASPGRQSGSSQPEAHPSARASQASTEAPGQQCTQVPGDPTMWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVAGRWGVSGQGGRRGRASLGTHTCCSLDRPSGSHQGGGRSQSRGFWWGL

SEQ ID NO: 763911 - protein, 453 aa, Homo sapiens
SGASPGRQSGSSQPEAHPSARASQASTEAPGQQCTQVPGDPTMWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 763912 - protein, 320 aa, Homo sapiens
SGASPGRQSGSSQPEAHPSARASQASTEAPGQQCTQVPGDPTMWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNIS

SEQ ID NO: 763913 - protein, 411 aa, Homo sapiens; identical to SEQ ID NO: 763909

SEQ ID NO: 763914 - protein, 453 aa, Homo sapiens; identical to SEQ ID NO: 763911

SEQ ID NO: 763915 - protein, 453 aa, Homo sapiens; identical to SEQ ID NO: 763911

SEQ ID NO: 763916 - protein, 453 aa, Homo sapiens; identical to SEQ ID NO: 763911

SEQ ID NO: 763917 - protein, 514 aa, Homo sapiens
DPQFIAQLMEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSSELCVLCTLLGIPRLECVYLGWSITDCGLSDFKCLV

SEQ ID NO: 763918 - protein, 514 aa, Homo sapiens; identical to SEQ ID NO: 763917

SEQ ID NO: 763919 - protein, 460 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 763920 - protein, 460 aa, Homo sapiens; identical to SEQ ID NO: 763919

SEQ ID NO: 763921 - protein, 460 aa, Homo sapiens; identical to SEQ ID NO: 763919

SEQ ID NO: 763922 - protein, 460 aa, Homo sapiens; identical to SEQ ID NO: 763919

SEQ ID NO: 763923 - protein, 460 aa, Homo sapiens; identical to SEQ ID NO: 763919

SEQ ID NO: 763924 - protein, 322 aa, Homo sapiens
MVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 763925 - protein, 251 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKVCI

SEQ ID NO: 763926 - protein, 110 aa, Homo sapiens
AASAAAVLLSSIHAARLKRTGPSQDNKSPNVKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 763927 - protein, 127 aa, Homo sapiens
AAVVSAGGGEKKRPPAPPIRHPREDATSPIPEPSPTTAEPEGTGRPWQSSSARLGRGAGGAAGPEAQSPPFAQPHRWGSAQRAGAGSGDGVLTPSPSPFSARHKPGAAPAPAPSSPPRQTRPAEAKP

SEQ ID NO: 763928 - protein, 127 aa, Homo sapiens; identical to SEQ ID NO: 763927

SEQ ID NO: 763929 - protein, 673 aa, Homo sapiens
AAVVSAGGGEKKRPPAPPIRHPREDATSPIPEPSPTTAEPEGTGRPWQSSSARLGRGAGGAAGPEAQSPPFAQPHRWGSAQRAGAGSGDGVLTPSPSPFSARHKPGAAPAPAPSSPPRQTRPAEAKPSGKSPALWQATLRTPSAPRAAASHCRLLRMRDCELGQAPPEALSLRPEAVSVPGRLDSVLEKGKEKMGLSSCKNKLRDPTDSTLPIMDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 763930 - protein, 460 aa, Homo sapiens; identical to SEQ ID NO: 763919

SEQ ID NO: 763931 - protein, 322 aa, Homo sapiens; identical to SEQ ID NO: 763924

SEQ ID NO: 763932 - protein, 322 aa, Homo sapiens; identical to SEQ ID NO: 763924

SEQ ID NO: 763933 - protein, 386 aa, Homo sapiens [sequence omitted]

SEQ ID NO: 763934 - protein, 957 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 763935 - protein, 957 aa, Homo sapiens; identical to SEQ ID NO: 763934

SEQ ID NO: 763936 - protein, 957 aa, Homo sapiens; identical to SEQ ID NO: 763934

SEQ ID NO: 763937 - protein, 644 aa, Homo sapiens
EVREGGGKEEEAGSGRCVGCGLAPKGRPRRRADPVASAIMDPAEAVLQEKALKFMCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 763938 - protein, 504 aa, Homo sapiens
EVREGGGKEEEAGSGRCVGCGLAPKGRPRRRADPVASAIMDPAEAVLQEKALKFMCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRSWSGSGLNFCLDPVLGDWGPYGQGLRCA

SEQ ID NO: 763939 - protein, 467 aa, Homo sapiens
PALGDPGLLSHEDVGGGMSGADNVNDSWSSSMYSVDTLDQGIIHILGRTELPGKNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRSWSGSGLNFCLDPVLGDWGPYGQGLRCA

SEQ ID NO: 763940 - protein, 447 aa, Homo sapiens
MPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRTWSGLGLNFCLDPVLGDWGPYGQGLRCA

SEQ ID NO: 763941 - protein, 326 aa, Homo sapiens [sequence omitted]

SEQ ID NO: 763942 - protein, 608 aa, Homo sapiens
EVREGGGKEEEAGSGRCVGCGLAPKGRPRRRADPVASAIMDPAEAVLQEKALKFMNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 763943 - protein, 316 aa, Homo sapiens
MEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRSWSGSGLNFCLDPVLGDWGPYGQGLRCA

SEQ ID NO: 763944 - protein, 487 aa, Homo sapiens
RGKRGRGEGRGGGIRALRWLRPGTKGAAPAESGPSGLGDYGPGRGGAAREGTQVYGSGSVAPSNLEQDAYSKIINSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRSWSGSGLNFCLDPVLGDWGPYGQGLRCA

SEQ ID NO: 763945 - protein, 494 aa, Homo sapiens
VFDRGLITPSPIKLKLTSVVAGVKWRDLGSLQTPPLASSDSRGLQCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFGCRSWSGSGLNFCLDPVLGDWGPYGQGLRCA

SEQ ID NO: 763946 - protein, 501 aa, Homo sapiens
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 763947 - protein, 217 aa, Homo sapiens
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGAQIRCKLLKG

SEQ ID NO: 763948 - protein, 501 aa, Homo sapiens; identical to SEQ ID NO: 763946

SEQ ID NO: 763949 - protein, 280 aa, Homo sapiens
PNPARAGSISRPQRAPGSVSAVAMTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 763950 - protein, 107 aa, Homo sapiens
LFSPFSLLCCILPFISFPLPASLSDSSFSQAHASPEPAVHCFRKNISTLSPPTHFVLTSPWKFDLKSWQLPKPETLPALPRQELSSLQPALQITSGNQHFPNRRLHL

SEQ ID NO: 763951 - protein, 280 aa, Homo sapiens; identical to SEQ ID NO: 763949

SEQ ID NO: 763952 - protein, 280 aa, Homo sapiens; identical to SEQ ID NO: 763949

SEQ ID NO: 763953 - protein, 239 aa, Homo sapiens
PNPARAGSISRPQRAPGSVSAVAMTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 763954 - protein, 267 aa, Homo sapiens
SPANSLNQATAISCLRCTEDLQSGSSFSISLQSRSITLNCCLDPSFDRAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 763955 - protein, 696 aa, Homo sapiens
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 763956 - protein, 696 aa, Homo sapiens; identical to SEQ ID NO: 763955

SEQ ID NO: 763957 - protein, 576 aa, Homo sapiens
MWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 763958 - protein, 644 aa, Homo sapiens [sequence omitted]

SEQ ID NO: 763959 - protein, 696 aa, Homo sapiens; identical to SEQ ID NO: 763955

SEQ ID NO: 763960 - protein, 696 aa, Homo sapiens; identical to SEQ ID NO: 763955

SEQ ID NO: 763961 - protein, 644 aa, Homo sapiens [sequence omitted]

SEQ ID NO: 763962 - protein, 510 aa, Homo sapiens
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSGVSPEHKQDINASSIGLSLYQAVVS

SEQ ID NO: 763963 - protein, 696 aa, Homo sapiens; identical to SEQ ID NO: 763955

SEQ ID NO: 763964 - protein, 696 aa, Homo sapiens; identical to SEQ ID NO: 763955

SEQ ID NO: 763965 - protein, 268 aa, Homo sapiens
EPDRCYRCTIVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 763966 - protein, 696 aa, Homo sapiens; identical to SEQ ID NO: 763955

SEQ ID NO: 763967 - protein, 511 aa, Homo sapiens
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGHLSPLTLLVCCSKSLVF

SEQ ID NO: 763968 - protein, 119 aa, Homo sapiens
MKQPQVNQRLPFLELLKSKGYFQVGQNLPCTPHPTLPKCQGQKLWRGAGTTSFTLSVWPHRYITQEGHKLETGAPRPPATVTNAVSWRSEGIKYRKNEVFLDVIESVNLLVGLFSFLLL

SEQ ID NO: 763969 - protein, 423 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 763970 - protein, 351 aa, Homo sapiens
MKQPQVNQRLPFLELLKSKGYFQVGQNLPCTPHPTLPKCQGQKLWRGAGTTSFTLSVWPHRYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 763971 - protein, 179 aa, Homo sapiens
ALELAFGLDHVSMRLWECFSITDSIHIKGLSVGVETVGHELELAVGWDEGDGAVILETSLSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 763972 - protein, 142 aa, Homo sapiens
PANQKLQLTSHGAHRYGQWFHNASTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 763973 - protein, 106 aa, Homo sapiens
MISDRVESRCCLGALYHASMMRLPAPDPVRGCRSQHPGLGAPGGSTRGHTCQTHQMEGPSLVSGHPPSLCPGTPAFPRPSALPSTLVSEAPFPEEAGLQEVSFLCP

SEQ ID NO: 763974 - protein, 117 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVSLARRGRGLGWRLSWLCLWTSPYLATL

SEQ ID NO: 763975 - protein, 423 aa, Homo sapiens; identical to SEQ ID NO: 763969

SEQ ID NO: 763976 - protein, 423 aa, Homo sapiens; identical to SEQ ID NO: 763969

SEQ ID NO: 763977 - protein, 423 aa, Homo sapiens; identical to SEQ ID NO: 763969

SEQ ID NO: 763978 - protein, 183 aa, Homo sapiens
RLGEAGVIDRGHISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 763979 - protein, 397 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQTQPDQY

SEQ ID NO: 763980 - protein, 191 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVGLFSFLLL

SEQ ID NO: 763981 - protein, 150 aa, Homo sapiens
CRTENASIFSLPSPPQVLICRNYRGDVDMSEVEHFMPILMEKEEEGMLSPILAHGGVRFMWIKHNNLYRIPLLGVLPGDSCVGVGVCAYPHACKQGWFVHSASIGHSHALLELPAACGDRQTMHDDMCDGCGERSRCDLNLFSPGAQEGK

SEQ ID NO: 763982 - protein, 83 aa, Homo sapiens
SLLREMRRPVGLRVYRVGQSLAKFPASGAARVGTHGKLNSLVGVLEAPKPGSRRGRLQPLWRPPRLRPRLRPPQVERWPGGES

SEQ ID NO: 763983 - protein, 74 aa, Homo sapiens
MEATAATAAAEASPGGAVAWRGILILGQPPVKRRRSVMPLEDWMNILQEPDEGVSNRDVRRLVGVDQSTKEKQL

SEQ ID NO: 763984 - protein, 155 aa, Homo sapiens [sequence omitted]

SEQ ID NO: 763985 - protein, 83 aa, Homo sapiens
ATSFILSDLQAYLMSSPKRWWVRENFAKGCQSINRSYDYVAEKWDLKEERDLQSGGLLPFFEWWLKIFPQTVPIWSGCPTAFY

SEQ ID NO: 763986 - protein, 933 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 763987 - protein, 174 aa, Homo sapiens
AYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLR

SEQ ID NO: 763988 - protein, 242 aa, Homo sapiens
MSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 763989 - protein, 49 aa, Homo sapiens
MVSLTQELCPVAMRVAEGHNKMLSNVAERVTVPRNFIRGALLEQAGQDI

SEQ ID NO: 763990 - protein, 355 aa, Homo sapiens
RPRALPDARARGHDVRFAEFLAYLLDPRTRREEPFNEHWERAHALCHPCRLRYDVVGKFETLAEDAAFVLGLAGASDLSFPGPPRPRGAAASRDLAARLFRDISPFYQRRLFDLYKMDFLLFNYSAPSYLRLLKRSWRSCGHAGQVPFRQDPRGMQVLPAPGPLFKSHCVHSPGRRASGRRAHLARLGGSPSQVALHACACLGLSPEACFLHLLQLTGTSPGPVDGQGLDNQGFRLLKAILGVSPAPEPVHGASEHNADTGVSVARACVLPTSPTLARTAAAKDESPPLAGLTMGPSREPGGSCLPLPSGLLSSPTRLALPRRHLRSQSGKTLGLQAPCQQSPWCNAVTGFMGLW

SEQ ID NO: 763991 - protein, 95 aa, Homo sapiens
SELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 763992 - protein, 414 aa, Homo sapiens
KPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGKGHDAWPFFLFYLTLMCVTLHQFRKQFLEISSLPLLQSPHSSMVSVTSSHL

SEQ ID NO: 763993 - protein, 71 aa, Homo sapiens
GVSDGSLWSVTEPVGSVMVIGFWVSLGSPWARFSSRLQPISSEQLCLSSQMTAKLQTPYRKRVETQCGHAS

SEQ ID NO: 763994 - protein, 153 aa, Homo sapiens
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPAPCLVNSHHLQESFREVKVRSSVVNEDKSTERFLSTSMVTLCGKLVRSEEARVTMG

SEQ ID NO: 763995 - protein, 132 aa, Homo sapiens
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPVTHRLPLPSTMTKSFLDLTRSQADTSAMLVQPPEA

SEQ ID NO: 763996 - protein, 211 aa, Homo sapiens
EPRAQGSESPISASPEVSAISTMASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 763997 - protein, 577 aa, Homo sapiens
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVKSASPEHTCVKSKTLDPMVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVIDDKGSILPPNTEGNIGIRIKPVRPVSLFMCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 763998 - protein, 148 aa, Homo sapiens
MCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 763999 - protein, 115 aa, Homo sapiens
MPRRRRRRGSSGAGGRGRTCSRTVRAELSFSVSQVERSLREGHYAQRLSRTAPVYLAAVIEYLTAKVLELAGNEAQNSGERNITPLLLDMVVHNDRLLSTLFNTTTISQVAPGED

SEQ ID NO: 764000 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 764001 - protein, 308 aa, Homo sapiens
MSKDPFGSTLRACLPNLNFFPSSENPGIQLPHPSSGKTGSWVRGAGVCGKSQPGVQVYREGVGPSLRYESPLLWLWFSLNGGTGAGGQGWEAPGEGFPPASCGRSHFSGDLVAGGAYHCPGCAGLSAPGSGRTGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 764002 - protein, 190 aa, Homo sapiens
MGGCLPPIVDSLPLPGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 764003 - protein, 311 aa, Homo sapiens
MKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 764004 - protein, 311 aa, Homo sapiens; identical to SEQ ID NO: 764003

SEQ ID NO: 764005 - protein, 46 aa, Homo sapiens
MRGEFALSNSGAHSKRSERNKKRTSKGRKCKGGTERKKLLGTTYYA

SEQ ID NO: 764006 - protein, 201 aa, Homo sapiens
MKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRGAMAWAGGGPGGRGRRGTLKTRWGR

SEQ ID NO: 764007 - protein, 311 aa, Homo sapiens; identical to SEQ ID NO: 764003

SEQ ID NO: 764008 - protein, 311 aa, Homo sapiens; identical to SEQ ID NO: 764003

SEQ ID NO: 764009 - protein, 311 aa, Homo sapiens; identical to SEQ ID NO: 764003

SEQ ID NO: 764010 - protein, 155 aa, Homo sapiens
MKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKP

SEQ ID NO: 764011 - protein, 311 aa, Homo sapiens; identical to SEQ ID NO: 764003

SEQ ID NO: 764012 - protein, 155 aa, Homo sapiens; identical to SEQ ID NO: 764010

SEQ ID NO: 764013 - protein, 335 aa, Homo sapiens
MKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTCELATNILLVAEITPLGDRGRLLLEKPQTLSFPAYNLITVEICRKY

SEQ ID NO: 764014 - protein, 155 aa, Homo sapiens; identical to SEQ ID NO: 764010

SEQ ID NO: 764015 - protein, 250 aa, Homo sapiens
MKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVCMLLTVNLPKDSADQTFLIM

SEQ ID NO: 764016 - protein, 311 aa, Homo sapiens; identical to SEQ ID NO: 764003

SEQ ID NO: 764017 - protein, 311 aa, Homo sapiens; identical to SEQ ID NO: 764003

SEQ ID NO: 764018 - protein, 155 aa, Homo sapiens; identical to SEQ ID NO: 764010

SEQ ID NO: 764019 - protein, 155 aa, Homo sapiens; identical to SEQ ID NO: 764010

SEQ ID NO: 764020 - protein, 145 aa, Homo sapiens
MKSAWEKCVGGIENTGVYRCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 764021 - protein, 71 aa, Homo sapiens
GLAGIRHERHSESGQLVGVDLNTGEPMVAAEVGVWDNYCVKKQLLHSCTVIATNILLVDEIMRAGMSSLKG

SEQ ID NO: 764022 - protein, 155 aa, Homo sapiens; identical to SEQ ID NO: 764010

SEQ ID NO: 764023 - protein, 155 aa, Homo sapiens; identical to SEQ ID NO: 764010

SEQ ID NO: 764024 - protein, 311 aa, Homo sapiens; identical to SEQ ID NO: 764003

SEQ ID NO: 764025 - protein, 311 aa, Homo sapiens; identical to SEQ ID NO: 764003

SEQ ID NO: 764026 - protein, 311 aa, Homo sapiens; identical to SEQ ID NO: 764003

SEQ ID NO: 764027 - protein, 311 aa, Homo sapiens; identical to SEQ ID NO: 764003

SEQ ID NO: 764028 - protein, 270 aa, Homo sapiens
MKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGKRMQLL

SEQ ID NO: 764029 - protein, 270 aa, Homo sapiens; identical to SEQ ID NO: 764028

SEQ ID NO: 764030 - protein, 155 aa, Homo sapiens; identical to SEQ ID NO: 764010

SEQ ID NO: 764031 - protein, 270 aa, Homo sapiens; identical to SEQ ID NO: 764028

SEQ ID NO: 764032 - protein, 270 aa, Homo sapiens; identical to SEQ ID NO: 764028

SEQ ID NO: 764033 - protein, 311 aa, Homo sapiens; identical to SEQ ID NO: 764003

SEQ ID NO: 764034 - protein, 311 aa, Homo sapiens; identical to SEQ ID NO: 764003

SEQ ID NO: 764035 - protein, 114 aa, Homo sapiens [sequence omitted]

SEQ ID NO: 764036 - protein, 155 aa, Homo sapiens; identical to SEQ ID NO: 764010

SEQ ID NO: 764037 - protein, 260 aa, Homo sapiens
MKMLVSGAGDIKLTKDGNVLLHEMQIQHPTASLIAKVATAQDDITKEREQQQIDQNKRKQQKQTKHNKTKKPTTKKKTQKKKNSTEEKKPNMDDNKYQIDGRIEISIETAEGRYAKNRLTAERKGSETRNQIDKTGTIKADEEELPRSEAQIKESKKKTLKKRLGDIKRGGRLKKKIRKNKRTEEERSLEGQVRESEDDVGTLRRVGEGGDRKKKDVQHTGVRDGVKSRGTRYRYRRMKLRRFRGRLRTNGKRSEKDAIQ

SEQ ID NO: 764038 - protein, 106 aa, Homo sapiens
GCSSGGCSQQHLLCSCQADLPILCTAQVRLESNPYLTWGYLAPKPSGAPGNRLRECPGRGTPSALSVGVFLGLLTVVWKQETPLFPTRHTTAPQPLGSVPDPTLRI

SEQ ID NO: 764039 - protein, 112 aa, Homo sapiens
TQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGCGGHRPIHQHG

SEQ ID NO: 764040 - protein, 280 aa, Homo sapiens [sequence omitted]

SEQ ID NO: 764041 - protein, 280 aa, Homo sapiens [sequence omitted]

SEQ ID NO: 764042 - protein, 209 aa, Homo sapiens
MPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSPGKNELPANSRAKVDKKRPQIAFPWLPTP

SEQ ID NO: 764043 - protein, 160 aa, Homo sapiens
RDAWGQTHASGFCPRGDSQREAPTQHPLPGSASPMGPYTQLSGGDSCCRALCHVNAGMLAPRAMNFVRWKAFFLEREFSWLASLPWALKAFRASSPLTVSLSLERRKEPMASSPTKSTSRQWPKLQRGRRDQPCPSASSVPAAEPGRHPNVAAVSNLQKP

SEQ ID NO: 764044 - protein, 248 aa, Homo sapiens
YTKIGTIQRRLAWPLRKDDTQIREAFHIFESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 764045 - protein, 102 aa, Homo sapiens
ADRPVLCLGLDFKTHVMKKSVYKPNFVVFVFISINGRNKKIRNAQLAQYNFILVVGEKEKISGTVNIRTRDNKVHGERTISETIERLQQLKEFRSKQAEEEF

SEQ ID NO: 764046 - protein, 723 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 764047 - protein, 723 aa, Homo sapiens; identical to SEQ ID NO: 764046

SEQ ID NO: 764048 - protein, 425 aa, Homo sapiens [sequence omitted]

SEQ ID NO: 764049 - protein, 300 aa, Homo sapiens
MYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNQVQMPGYLNDKGEYSNYQVYRCGPFDKSLPGPHVRHTGNNYTALKLRHKNPQVREGKRRNEETQKNKDIIPEPNVTAGANSTRSKRNLDKRDRNTAEPAEVMIRDNKAESAKKGRTNKKNTEHTRK

SEQ ID NO: 764050 - protein, 723 aa, Homo sapiens; identical to SEQ ID NO: 764046

SEQ ID NO: 764051 - protein, 664 aa, Homo sapiens
MYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 764052 - protein, 682 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNEKITQIGSMEKEEQRFRKIDFVL

SEQ ID NO: 764053 - protein, 105 aa, Homo sapiens
LPLNSSHILSFPPPLISIPFSTASPLPILAHIDLDPGCTLNKKIRNAQLAQYNFILVVGEKEKISGTVNIRTRDNKVHGERTISETIERLQQLKEFRSKQAEEEF

SEQ ID NO: 764054 - protein, 315 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 764055 - protein, 296 aa, Homo sapiens
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 764056 - protein, 315 aa, Homo sapiens; identical to SEQ ID NO: 764054

SEQ ID NO: 764057 - protein, 315 aa, Homo sapiens; identical to SEQ ID NO: 764054

SEQ ID NO: 764058 - protein, 265 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 764059 - protein, 315 aa, Homo sapiens; identical to SEQ ID NO: 764054

SEQ ID NO: 764060 - protein, 296 aa, Homo sapiens; identical to SEQ ID NO: 764055

SEQ ID NO: 764061 - protein, 321 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETPPLRLWRFDRAI

SEQ ID NO: 764062 - protein, 373 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 764063 - protein, 373 aa, Homo sapiens; identical to SEQ ID NO: 764062

SEQ ID NO: 764064 - protein, 373 aa, Homo sapiens; identical to SEQ ID NO: 764062

SEQ ID NO: 764065 - protein, 106 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPASWLSRLSKRAGVTWGNDGWGHFP

SEQ ID NO: 764066 - protein, 511 aa, Homo sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWEKGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 764067 - protein, 511 aa, Homo sapiens; identical to SEQ ID NO: 764066

SEQ ID NO: 764068 - protein, 415 aa, Homo sapiens
MVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWEKGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 764069 - protein, 138 aa, Homo sapiens
VFTGHHEPHCPNFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 764070 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 764071 - protein, 615 aa, Homo sapiens
RVTSRSGPAPARRNSVTTGYGGVRALCGWTPSSGATPRNRLLLQLLGSPGRRYYSLPPHQKVPLPSLSPTMQAGTIARWKKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQAPPPTPAPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 764072 - protein, 615 aa, Homo sapiens; identical to SEQ ID NO: 764071

SEQ ID NO: 764073 - protein, 189 aa, Homo sapiens
MARSFSLLMAVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 764074 - protein, 698 aa, Homo sapiens
MFTIIKTQGNEILMLIFMFCQYKFPELELLYAHFKAFDNFSSSLLFLSTDLINFGHIPGITVEINYVDTNLTFQGYFPSLESAPSQLSTVAHVCNPSTLGGQGRRIMRSRDQDHPGQHGETPSLLKIQKLAGCGGMHLESQLLRRLRQENSLNLGGGNCSEAKIVPLHSSLATEQDSVKKRKKERKKVLLNISFIDKSCSFNDSIIFEFLLLAKCLISTGDTAVRFLNRGTTLIELAYRLMKNINKETRIAISSVSQCIVRDVAPKMYGITHEVIPNLISTFKKKYGTPVKKLNDSKLVSESFPSIKKEKEKYEPVLSITEKEYFSTIFDVIKKLKYIRGTPRSALGPKDCVSEEVISETIYEKYKMSRSWLKMSMRGKERGLSTAFWAESTANRNAESEKYHTIKNECNLEAVGLLHLKVFWLGRNEDKKVNGDDNMKEFINNFLDLLKNFGNLLIGINKEWHNQIRILQRSLGYSVESGLEQGPVRNREVNCNEATRDESSMLYSDAGRTEGQGLVFLVMKLTKLCDFQDGECRMGNSKGRALEIWFEQLGKQMHSPRKTFAEKPVERGGPETLKLNKLPGDSCEVNNGELEQAVEPESLEKKWVDIEMGCWNYYYYYYYCFFEMESCCVTQAGVQWCDLGSLQPPPAGLKRFSCLSLPSSWDYRRPPSCPAEFLYFLVETGFHHFGQAGLELLTS

SEQ ID NO: 764075 - protein, 353 aa, Homo sapiens
SGDALSSRVPGPASFKMYTIYEILCKLSLEGHHSTPSGAYGSVKAYTNFDAEGDALNIERTIRTKGVGKFTIVNILTNSRNARREDVAFAYAEKDHKGTYISTEVSLTGHLETVILGLLKTPAQYDASELKASMKGLGTEEDSLVEIICSTTNQELQEINRVYKEMYKTDLEKDIISDTYGDFCKLMFALANVRRPEDGSVVDYELIDQDARDFCDAGVKRKRTDVPKWISMMTEESMSHLQKVFDRYKSYSPSRESIKKEVKGDLENAFLNLVQCIQNKPLYFADWLYYSMKGQGARDKVLIRIIVSRSEVDMLKIRSEFKRKYGMSPYYYIQQDTKNDYQKALLYLCGGDD

SEQ ID NO: 764076 - protein, 502 aa, Homo sapiens
LFRGHRQRSVSDSKSGCRPAHSPRVTLSPRLRAPSRPPTGVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 764077 - protein, 513 aa, Homo sapiens
LFRGHRQRSVSDSKSGCRPAHSPRVTLSPRLRAPSRPPTGVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAARNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 764078 - protein, 513 aa, Homo sapiens; identical to SEQ ID NO: 764077

SEQ ID NO: 764079 - protein, 542 aa, Homo sapiens
LFRGHRQRSVSDSKSGCRPAHSPRVTLSPRLRAPSRPPTGVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 764080 - protein, 484 aa, Homo sapiens
LFRGHRQRSVSDSKSGCRPAHSPRVTLSPRLRAPSRPPTGVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQNLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 764081 - protein, 977 aa, Homo sapiens
MAMALELQAQASPQPEPEELLIVKLELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGDSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 764082 - protein, 433 aa, Homo sapiens [sequence omitted]

SEQ ID NO: 764083 - protein, 154 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVRAKDRWDHLPVWRQSEEEASINLKA

SEQ ID NO: 764084 - protein, 262 aa, Homo sapiens [sequence omitted]

SEQ ID NO: 764085 - protein, 262 aa, Homo sapiens [sequence omitted]

SEQ ID NO: 764086 - protein, 262 aa, Homo sapiens [sequence omitted]

SEQ ID NO: 764087 - protein, 277 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGMAARLETRTRNWGSREACLGKGGMQREGAL

SEQ ID NO: 764088 - protein, 264 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVPLLMQCLF

SEQ ID NO: 764089 - protein, 348 aa, Homo sapiens
MDRYVSPLARCRMALFPERCSSTDTPSPCPDLAYWSGSRPVWVLMEPSDRLVQHVSPPLSKRCVAAPVSHGEGSGPHREPGGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 764090 - protein, 146 aa, Homo sapiens [sequence omitted]

SEQ ID NO: 764091 - protein, 294 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARSGQEEMMDEQMRKKSRFALLMSDLISSCLHFRQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 764092 - protein, 173 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAASMVAVWALSHPQWHQSQVLFPLLPARSLPPSGSMTSVAYRSGCQMGPH

SEQ ID NO: 764093 - protein, 172 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAASMVAVWALSHPQWHQSQVLFPLLPARSLPPSGSMTSVAYRCCHSNSY

SEQ ID NO: 764094 - protein, 154 aa, Homo sapiens; identical to SEQ ID NO: 764083

SEQ ID NO: 764095 - protein, 150 aa, Homo sapiens
LLNSAAARQELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 764096 - protein, 116 aa, Homo sapiens
MDWLMEHEDDPDVDEPLETPLGHILGREPTSSEQGGLEGSGSAAGEGKPALSEEERQEQTKRMLELVAQKQREREEREWNGKMIFPYSLAIQQLISSLTTPSRIPLNIQTFLLFSL

SEQ ID NO: 764097 - protein, 262 aa, Homo sapiens [sequence omitted]

SEQ ID NO: 764098 - protein, 262 aa, Homo sapiens [sequence omitted]

SEQ ID NO: 764099 - protein, 262 aa, Homo sapiens [sequence omitted]

SEQ ID NO: 764100 - protein, 262 aa, Homo sapiens [sequence omitted]

SEQ ID NO: 764101 - protein, 262 aa, Homo sapiens [sequence omitted]

SEQ ID NO: 764102 - protein, 203 aa, Homo sapiens
MDWMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 764103 - protein, 131 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARSGQGK

SEQ ID NO: 764104 - protein, 230 aa, Homo sapiens
MDWLMEHEDDPDVDEPLETPLGHILGREPTSSEQGGLEGSGSAAGEGKPALSEEERQEQTKRMLELVAQKQREREEREEREALEREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 764105 - protein, 175 aa, Homo sapiens
MARGRYSWCFCPQGEGSGPHREPGGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKVGD

SEQ ID NO: 764106 - protein, 149 aa, Homo sapiens
MDWLMEHEDDPDVDEPLETPLGHILGREPTSSEQGGLEGSGSAAGEGKPALSEEERQEQTKRMLELVAQKQREREEREEREALERERQRRRQGQELSGASHLPVAAVVLLTTLALLSPLPVLSPPREWREKDEEGGGKGGGGRLTLYHD

SEQ ID NO: 764107 - protein, 138 aa, Homo sapiens
MDWLMEHEDDPDVDEPLETPLGHILGREPTSSEQGGLEGSGSAAGEGKPALSEEERQEQTKRCVELLALTRRPPSPSVSLPSPIPSPSLSPNEKAGPRPLDAGVTGREKGKKREESRSLSVNQAKCVAREGQQVYALD

SEQ ID NO: 764108 - protein, 87 aa, Homo sapiens
GSSQLKSTLLEQPLQRLLQEHSGIFGFSVSHTTRNPRPGEENGKDYYFVTREVMQRDIAAGDFIEHAEFSGNLYGTSKVAVQAVQAI

SEQ ID NO: 764109 - protein, 115 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764110 - protein, 115 aa, Homo sapiens; identical to SEQ ID NO: 764109

SEQ ID NO: 764111 - protein, 160 aa, Homo sapiens
MAGSQKEEIMPPQQGVPFQESGCWGSMGAQSRERSGRDHSGTWICAGGSQETFHLGAPVETTCLAGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764112 - protein, 160 aa, Homo sapiens; identical to SEQ ID NO: 764111

SEQ ID NO: 764113 - protein, 191 aa, Homo sapiens
RVGSCAFPVVCFTGCLHPGAQVLSGLQGKRWVGHWAPSSPRWVTGLSARYHEEPEARRGERQREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLGPGLRRAEGGAL

SEQ ID NO: 764114 - protein, 160 aa, Homo sapiens; identical to SEQ ID NO: 764111

SEQ ID NO: 764115 - protein, 191 aa, Homo sapiens; identical to SEQ ID NO: 764113

SEQ ID NO: 764116 - protein, 154 aa, Homo sapiens
MGLLPCKGPGPGPLGIYSWLRRVGPEAGVVGIRDLSTPSSQSSRQTHPRLTTEAAPQQTGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764117 - protein, 247 aa, Homo sapiens
MHGSKWLDSWVGWGSQSRLPEGLEVTPPGGDGSSQVGCHQSRQHCLLGTPGEADRVSGFQLGGSPAENPVKPAFHSSPVCPEPGLRAALCMPALPTWQSSGGRTPRLSGDSQANVSIPGSALSCHEFRKAEAAQQMGTRGRTAIQQPLFSPPGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764118 - protein, 149 aa, Homo sapiens
MTSVSRAGGGGPVRRCHVGSVGGRGGPGCCGARWPGWLRPPWAGPHRTPLFSPPGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764119 - protein, 231 aa, Homo sapiens
GFTLLLSCVLCLPSLGLLSTDYWATVFLSGRTLALEADRVSGFQLGGSPAENPVKPAFHSSPVCPEPGLRAALCMPALPTWQSSGGRTPRLSGDSQANVSIPGSALSCHEFRKAEAAQQMGTRGRTAIQQPLFSPPGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAI

SEQ ID NO: 764120 - protein, 115 aa, Homo sapiens; identical to SEQ ID NO: 764109

SEQ ID NO: 764121 - protein, 137 aa, Homo sapiens
MAGSQKEEIMPPQQGVPFQESGCWGSMGAQSRERSGRDHSGTWICAGGSQETFHLGAPVETTCLAGMSGPRPVVLSGPSGAGKSTLLKRLLQEHSGIFGFSVSRESRALVEGYHEEPEARRGERQRLLLCNQGGDAA

SEQ ID NO: 764122 - protein, 120 aa, Homo sapiens
MAGSQKEEIMPPQQGVPFQESGCWGSMGAQSRERSGRDHSGTWICAGGSQETFHLGAPVETTCLAGMSGPRPVVLSGPSGAGKSTLLKRLLQEHSGIFGFSVSRESRALVEGCVDLKAAE

SEQ ID NO: 764123 - protein, 207 aa, Homo sapiens
MHGSKWLDSWVGWGSQSRLPEGLEVTPPGGDGSSQVGCHQSRQHCLLGTPGEADRVSGFQLGGSPAENPVKPAFHSSPVCPEPGLRAALCMPALPTWQSSGGRTPRLSGDSQANVSIPGSALSCHEFRKAEAAQQMGTRGRTAIQQPLFSPPGMSGPRPVVLSGPSGAGKSTLLKRLLQEHSGIFGFSVSRESRALVEGCVDLKAAE

SEQ ID NO: 764124 - protein, 137 aa, Homo sapiens
ARRNSARGLHRACRVLGEPVWHEQGGGAGRAGHLNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 764125 - protein, 115 aa, Homo sapiens; identical to SEQ ID NO: 764109

SEQ ID NO: 764126 - protein, 110 aa, Homo sapiens
LPPAAPLYRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 764127 - protein, 163 aa, Homo sapiens
MESSKEPGLFDVVIINDSLDQAYAELKEALSEVGPSLCLPGQGPRGGLGARPLLSMRPLRLDGTVLPKHWHETPRSTVEGEQEAQPFLDTSPPNSLSSSLAGNQESSKDRRLRLAVCSRHPGPIQDQGSSIEPPPWQAIRQLCALGQHVEWRRCCPCGWNILG

SEQ ID NO: 764128 - protein, 120 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTRSSGCGSATLKPRRAW

SEQ ID NO: 764129 - protein, 78 aa, Homo sapiens
MPGSDCHPLFEEQRLRQRNTETEESLVKRLAAAQADMESSKEPGLFDVVIINDSLDQAYAELKEALSEEIKKAQRTGA

SEQ ID NO: 764130 - protein, 115 aa, Homo sapiens; identical to SEQ ID NO: 764109

SEQ ID NO: 764131 - protein, 137 aa, Homo sapiens; identical to SEQ ID NO: 764121

SEQ ID NO: 764132 - protein, 149 aa, Homo sapiens; identical to SEQ ID NO: 764118

SEQ ID NO: 764133 - protein, 120 aa, Homo sapiens; identical to SEQ ID NO: 764122

SEQ ID NO: 764134 - protein, 115 aa, Homo sapiens; identical to SEQ ID NO: 764109

SEQ ID NO: 764135 - protein, 115 aa, Homo sapiens; identical to SEQ ID NO: 764109

SEQ ID NO: 764136 - protein, 115 aa, Homo sapiens; identical to SEQ ID NO: 764109

SEQ ID NO: 764137 - protein, 62 aa, Homo sapiens
MAPPLPQINYYFVTREVMQRDIAAGDFIEHAEFSGNLYGTRWAMRGCGWAPRVAVGNRDPGS

SEQ ID NO: 764138 - protein, 197 aa, Homo sapiens
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 764139 - protein, 804 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWALGPVTASRSIRAAFSLNRSLPPWRPEAACWWGPRGVSPADSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKDLHFSFN

SEQ ID NO: 764140 - protein, 764 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKDLHFSFN

SEQ ID NO: 764141 - protein, 1065 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWALGPVTASRSIRAAFSLNRSLPPWRPEAACWWGPRGVSPADSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764142 - protein, 1175 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWALGPVTASRSIRAAFSLNRSLPPWRPEAACWWGPRGVSPADSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEPDFFSKLAAMFRGLIFHSSRSGNREVQDSHSTSYPSLLSHLTSMYLNAPALALPVARMQLPGPGLRSFHPLASSLPCDFHLLNLRTLQAEVSVPQRDMLRAEFYGVPPCSAPSLASRMRSRPLSRYSAPNLQDQVLAFPYPHASLCQHCLWAEALLHLRSLKALRPLPWALSVIQEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764143 - protein, 1071 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWALGPVTASRSIRAAFSLNRSLPPWRPEAACWWGPRGVSPADSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPSPPSTHRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764144 - protein, 346 aa, Homo sapiens
RGEGPNPAIPSSRSGCRAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764145 - protein, 518 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWALGPVTASRSIRAAFSLNRSLPPWRPEAACWWGPRGVSPADSDSSTDIFCHMMPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLSRGDLSKP

SEQ ID NO: 764146 - protein, 134 aa, Homo sapiens [sequence omitted]

SEQ ID NO: 764147 - protein, 68 aa, Homo sapiens
PLGPTWCPGALDLLALPPQVQPRRYLKKLPLQANFYPMPVMAYIQDAQKRLTLHTAQALGVSSLKDGE

SEQ ID NO: 764148 - protein, 92 aa, Homo sapiens
ADSFPMVIFSPSLSCATHRLLRSLVNLKQVIIHAAHYLVLGDKETYHFDPEAPFLQVVSPSWVCMGTLWCVQVPSQELLDGGAASLFPSPSG

SEQ ID NO: 764149 - protein, 1065 aa, Homo sapiens; identical to SEQ ID NO: 764141

SEQ ID NO: 764150 - protein, 541 aa, Homo sapiens
MPFYSYDVPHTCGPDPKICCQFDFKRLPGGRINCPWKVPPRAITEANVAERAALLLDQYRKKSRLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKDLHFSFN

SEQ ID NO: 764151 - protein, 328 aa, Homo sapiens
RLTRGPIRRVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764152 - protein, 292 aa, Homo sapiens
AGQHSLFASPGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEVSVPQRDMLEQSSDGVPPCSAPSLASRMRSRPLSRYSAPNLQDQVLAFPYPHASLCQHCLWAEALLHLRSLKALRPLPWALSVIQEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 764153 - protein, 281 aa, Homo sapiens
QFTWQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERYLLPALS

SEQ ID NO: 764154 - protein, 64 aa, Homo sapiens
MSGREGGKKKPLKQPKKQAKEMDEEDKAFKQKQKEEQKKLEELKAKAAGKGPLATGGIKKSGKK

SEQ ID NO: 764155 - protein, 91 aa, Homo sapiens
RPPTRREKTTEGGEGGKKKPLKQPKKQAKEMDEEDKAFKQKQKEEQKKLEELKAKAAGKGPLATKVELRNLAKSKLFLVPEEMVTLYFICI

SEQ ID NO: 764156 - protein, 100 aa, Homo sapiens
WGRSSFPVAGSGEAAAGAMSGREGGKKKPLKQPKKQAKEMDEEDKAFKQKQKEEQKKLEELKAKAAGKGPLATKVELRNLAKSKLFLVPEEMVTLYFICI

SEQ ID NO: 764157 - protein, 100 aa, Homo sapiens; identical to SEQ ID NO: 764156

SEQ ID NO: 764158 - protein, 112 aa, Homo sapiens
MSGREGKCSGTVRTAGTAGWGPGGRGRPNVLVSPTGGKKKPLKQPKKQAKEMDEEDKAFKQKQKEEQKKLEELKAKAAGKGPLATKVELRNLAKSKLFLVPEEMVTLYFICI

SEQ ID NO: 764159 - protein, 100 aa, Homo sapiens; identical to SEQ ID NO: 764156

SEQ ID NO: 764160 - protein, 100 aa, Homo sapiens; identical to SEQ ID NO: 764156

SEQ ID NO: 764161 - protein, 71 aa, Homo sapiens
GSPTTQLSKEMDEEDKAFKQKQKEEQKKLEELKAKAAGKGPLATKVELRNLAKSKLFLVPEEMVTLYFICI

SEQ ID NO: 764162 - protein, 112 aa, Homo sapiens
FRILIRPSPIGEIFAPRGPKNSGHRRAAGAMSGREGGKKKPLKQPKKQAKEMDEEDKAFKQKQKEEQKKLEELKAKAAGKGPLATKVELRNLAKSKLFLVPEEMVTLYFICI

SEQ ID NO: 764163 - protein, 69 aa, Homo sapiens
KRRPNRSIGDWLPAPPRVDVSIKLISIPAPSIRLQKTRGGGRRHVRPRRWQEEATETAQEAGQGDGRGR

SEQ ID NO: 764164 - protein, 64 aa, Homo sapiens; identical to SEQ ID NO: 764154

SEQ ID NO: 764165 - protein, 210 aa, Homo sapiens
ILQNHPWETVGAVRERYSNVCSDLVKEFNKYDTDGSKWINQYTGINAIFKKEFSIDVGMRDFGTEIFFHPEFANPDFTQPISEVVDEVIQNCPIDVRRPLYKNIVLSGGSTMFRDFGRRLQRDLKRTEMSGREGGKKKPLKQPKKQAKEMDEEDKAFKQKQKEEQKKLEELKAKAAGKGPLATKVELRNLAKSKLFLVPEEMVTLYFICI

SEQ ID NO: 764166 - protein, 64 aa, Homo sapiens; identical to SEQ ID NO: 764154

SEQ ID NO: 764167 - protein, 64 aa, Homo sapiens; identical to SEQ ID NO: 764154

SEQ ID NO: 764168 - protein, 71 aa, Homo sapiens; identical to SEQ ID NO: 764161

SEQ ID NO: 764169 - protein, 90 aa, Homo sapiens
FGTGRQVTMSGREGGKKKPLKQPKKQAKEMDEEDKAFKQKQKEEQKKLEELKAKAAGKGPLATKVELRNLAKSKLFLVPEEMVTLYFICI

SEQ ID NO: 764170 - protein, 100 aa, Homo sapiens; identical to SEQ ID NO: 764156

SEQ ID NO: 764171 - protein, 90 aa, Homo sapiens; identical to SEQ ID NO: 764169

SEQ ID NO: 764172 - protein, 112 aa, Homo sapiens; identical to SEQ ID NO: 764162

SEQ ID NO: 764173 - protein, 100 aa, Homo sapiens; identical to SEQ ID NO: 764156

SEQ ID NO: 764174 - protein, 100 aa, Homo sapiens; identical to SEQ ID NO: 764156

SEQ ID NO: 764175 - protein, 210 aa, Homo sapiens; identical to SEQ ID NO: 764165

SEQ ID NO: 764176 - protein, 96 aa, Homo sapiens
PSCQHSLGEAAAGAMSGREGGKKKPLKQPKKQAKEMDEEDKAFKQKQKEEQKKLEELKAKAAGKGPLATKVELRNLAKSKLFLVPEEMVTLYFICI

SEQ ID NO: 764177 - protein, 112 aa, Homo sapiens; identical to SEQ ID NO: 764158

SEQ ID NO: 764178 - protein, 101 aa, Homo sapiens
WGRSSFPVAGSGEAAAGAMSGREGKCSGTVRTAGTAGWGPGGRGRPNVLVSPTGGKKKPLKQPKKQAKEMDEVRAGAEALAGAGALGDRPELNTLCLSPGR

SEQ ID NO: 764179 - protein, 67 aa, Homo sapiens
EDPISGQDEEDKAFKQKQKEEQKKLEELKAKAAGKGPLATKVELRNLAKSKLFLVPEEMVTLYFICI

SEQ ID NO: 764180 - protein, 85 aa, Homo sapiens
WGRSSFPVAGSGEAAAGAMSGREGGKKKPLKQPKKQAKEMDEEDKAFKQKQKEEQKKLEELKAKAAGKGPLGKWGPNGAQAGQTL

SEQ ID NO: 764181 - protein, 64 aa, Homo sapiens; identical to SEQ ID NO: 764154

SEQ ID NO: 764182 - protein, 64 aa, Homo sapiens; identical to SEQ ID NO: 764154

SEQ ID NO: 764183 - protein, 665 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 764184 - protein, 647 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQTGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 764185 - protein, 517 aa, Homo sapiens
MLPLSLQTVFSLYFWVNWRRASTLFTCLQELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 764186 - protein, 517 aa, Homo sapiens; identical to SEQ ID NO: 764185

SEQ ID NO: 764187 - protein, 122 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVACSLQHVIGETLASTRGDTDGDFKEQN

SEQ ID NO: 764188 - protein, 665 aa, Homo sapiens; identical to SEQ ID NO: 764183

SEQ ID NO: 764189 - protein, 517 aa, Homo sapiens; identical to SEQ ID NO: 764185

SEQ ID NO: 764190 - protein, 517 aa, Homo sapiens; identical to SEQ ID NO: 764185

SEQ ID NO: 764191 - protein, 145 aa, Homo sapiens
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAG

SEQ ID NO: 764192 - protein, 408 aa, Homo sapiens
MNTTDNGVNCLCAICGDRATGKHYGASSCDGCKGFFRRSIRKSHIYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 764193 - protein, 332 aa, Homo sapiens [sequence omitted]

SEQ ID NO: 764194 - protein, 100 aa, Homo sapiens
PESPLCGHEAAAVTAWLPRGGPGEPLRSREASAWLPRGGPGEPLRSREAGLWDLLARPPVALGPWEQGNARAEAVAASLLSVFIESAGYCLTSPPTFQFV

SEQ ID NO: 764195 - protein, 390 aa, Homo sapiens
MNTTDNGVNCLCAICGDRATGKHYGASSCDGCKGFFRRSIRKSHIYSCRFSRQCVVDKDKRNQCRYCRLRKCFRAGMKKEAVQNERDRISTRRSTFDGSNIPSINTLAQAEVRSRQISVSSPGSSTDINVKLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 764196 - protein, 409 aa, Homo sapiens
MCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKKPGFDDYPLGAPDRQLAQLLG

SEQ ID NO: 764197 - protein, 409 aa, Homo sapiens; identical to SEQ ID NO: 764196

SEQ ID NO: 764198 - protein, 318 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKRRIQLGEIKSA

SEQ ID NO: 764199 - protein, 318 aa, Homo sapiens; identical to SEQ ID NO: 764198

SEQ ID NO: 764200 - protein, 318 aa, Homo sapiens; identical to SEQ ID NO: 764198

SEQ ID NO: 764201 - protein, 259 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKRRIQLGEIKSA

SEQ ID NO: 764202 - protein, 299 aa, Homo sapiens
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKRRIQLGEIKSA

SEQ ID NO: 764203 - protein, 208 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLAISESHMNGGVFSYLR

SEQ ID NO: 764204 - protein, 268 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKPAEFSSCPLNSDEEVNKWLHFYEMKAPLVCLPVFVSRDPGFDLRLEHTHFFSRHGEGGHYHYDTTPDIVEYLGYFLPAEFLYRIDQPKRRIQLGEIKSA

SEQ ID NO: 764205 - protein, 259 aa, Homo sapiens; identical to SEQ ID NO: 764201

SEQ ID NO: 764206 - protein, 108 aa, Homo sapiens
MALRSVMFSDVSIDFSPEEWEYLDLEQKDLYRDVMLENYSNLVSLAGCFISKPDVISSLEQGKEPWKVVRKGRRQYPDLETKYETKKLSLENDIYEINLSQWKIMERI

SEQ ID NO: 764207 - protein, 465 aa, Homo sapiens
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 764208 - protein, 86 aa, Homo sapiens
PKVTMMQEMGSHDLGQLHSCGFAGYRLPPGCFHVAGGPSDLPSGKSRGWPASQWRRRPRCVRGSGTLKSGHGDGKVICWNPFAFPR

SEQ ID NO: 764209 - protein, 79 aa, Homo sapiens
MNGILLGYEIRYWKAGDKEAAADRVRTAGLDTSARVSGLHPNTKYHVTVRAYNRAGTGPASPSANATTMKPPPRRPPGN

SEQ ID NO: 764210 - protein, 170 aa, Homo sapiens
AKEEARSPADKFPEKAKSPVKEEVKSPEKAKSPLKEDAKAPEKEIPKKEEVKSPFPGSLRLYFNSGPPAALYPKLRRLHSEIPPPSRKKQVSSTGKKWCRILVCKRWRLLALLSSKASPPMLPCSLLHPARNSIPLTPTRLLPTTCSVLNVPTLNLPRGGGSGPFRILSS

SEQ ID NO: 764211 - protein, 736 aa, Homo sapiens
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 764212 - protein, 692 aa, Homo sapiens
MKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 764213 - protein, 692 aa, Homo sapiens; identical to SEQ ID NO: 764212

SEQ ID NO: 764214 - protein, 262 aa, Homo sapiens [sequence omitted]

SEQ ID NO: 764215 - protein, 736 aa, Homo sapiens; identical to SEQ ID NO: 764211

SEQ ID NO: 764216 - protein, 498 aa, Homo sapiens
MLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 764217 - protein, 736 aa, Homo sapiens; identical to SEQ ID NO: 764211

SEQ ID NO: 764218 - protein, 862 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEGRGERGSQRGNGGLQLAKRQDPPLLTTCSLLPQNLKAANTDPTAPPYDTLLVFDYEGSGSDAASLSSLTSSASDQDQDYDYLNEWGSRFKKLADMYGGGEDD

SEQ ID NO: 764219 - protein, 595 aa, Homo sapiens
MQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 764220 - protein, 263 aa, Homo sapiens
AVDLEDPTTPSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 764221 - protein, 835 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGLAAVGLWARELLCLLVQLNFFF

SEQ ID NO: 764222 - protein, 712 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQT

SEQ ID NO: 764223 - protein, 489 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKIRVASEAKFPEASYLP

SEQ ID NO: 764224 - protein, 446 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFAWACCD

SEQ ID NO: 764225 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 764226 - protein, 829 aa, Homo sapiens; identical to SEQ ID NO: 764225

SEQ ID NO: 764227 - protein, 116 aa, Homo sapiens
MNNAFFHFYLQKPLGEGREGLTERKWRLAAGKRQDPPLLTTCSLLPQNLKAANTDPTAPPYDTLLVFDYEGSGSDAASLSSLTSSASDQDQDYDYLNEWGSRFKKLADMYGGGEDD

SEQ ID NO: 764228 - protein, 808 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEVLLLCRSPPWQEALATGYSLDPAWPVPPFPPTTPGKTKTQPFHKYMSP

SEQ ID NO: 764229 - protein, 540 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLAWACCD

SEQ ID NO: 764230 - protein, 68 aa, Homo sapiens
APVVPTGPCVVSRAEMAGVGRPDLVGLGEPGPIGEWTAPRRRLPTCLPGPSCSGWLSRLSAGGGCGPA

SEQ ID NO: 764231 - protein, 248 aa, Homo sapiens
TPRVGGATEGLWARSWNLRLSVRLQFLTPTLRAARTMAAPPQLRALLVVVNALLRKRRYHAALAVLKGFRNGAVYGAKIRAPHALVMTFLFRNGSLQEKLWAILQATYIHSWNLARFVFTYKGLRALQSYIQGKTYPAHAFLAAFLGGILVFGENNNINSQINMYLLSRVLFALSRLAVEKGYIPEPRWDPFPLLTAVVWGLVLWLFEYHRSTLQPSLQSSMTYLYEDSNVWHDISDFLVYNKSRPSN

SEQ ID NO: 764232 - protein, 107 aa, Homo sapiens
TPRVGGATEGLWARSWNLRLSVRLQFLTPTLRAARTMAAPPQLRALLVVVNALLRKRRYHAALAVLKGFRNGAVYGAKIRAPHALVMTFLFRNGRSTCTCCHASCLP

SEQ ID NO: 764233 - protein, 248 aa, Homo sapiens; identical to SEQ ID NO: 764231

SEQ ID NO: 764234 - protein, 291 aa, Homo sapiens
TPRVGGATEGLWARSWNLRLSVRLQFLTPTLRAARTMAAPPQLRALLVVVNALLRKRRYHAALAVLKGFRNGAVEWGRRAGLGLRDVLPGVRGASSKSDAAVLFALEQSSCVSKSRSYGAKIRAPHALVMTFLFRNGSLQEKLWAILQATYIHSWNLARFVFTYKGLRALQSYIQGKTYPAHAFLAAFLGGILVFGENNNINSQINMYLLSRVLFALSRLAVEKGYIPEPRWDPFPLLTAVVWGLVLWLFEYHRSTLQPSLQSSMTYLYEDSNVWHDISDFLVYNKSRPSN

SEQ ID NO: 764235 - protein, 210 aa, Homo sapiens
TAGPAEAAMREAEAGPPQVGLSRPTCSLPASSPGPALPPGCVSRPDSGLPTTSLDSAPAQLPVALVGPQLPEAKLPRPRSGLTVASPGSAPALRWHLQVPNGLRSVGSSRPSLGLPAASAGPNRPEVGLSRPSSSLPAASAGLSCPQVGLEVGLEELQVGLPGPSSVLLASPGAKLPRVSLSRPSSSCLPVASFGPAQLMALSSLPRPRF

SEQ ID NO: 764236 - protein, 263 aa, Homo sapiens
SWACRGRHAGGRGRASSSRPLQTHLQPPGVLSGPSSSSRLRLQARLLPPNNLFGLSACDLLAALVGPQLPQAKLPRPRSGLTVASPGSALPPGCVSRPDSGLPTTSLDSAPAQLPVALVGPQLPEAKLPRPRSGLTVASPGSAPALRWHLQVPNGLRSVGSSRPSLGLPAASAGPNRPEVGLSRPSSSLPAASAGLSCPQVGLEVGLEELQVGLPGPSSVLLASPGAKLPRVSLSRPSSSCLPVASFGPAQLMALSSLPRPRF

SEQ ID NO: 764237 - protein, 1682 aa, Homo sapiens
MLASPEPKGLVPFTKESFELIKQHIAKTHNEDHEEEDLKPNPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHLILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSKEKIKQSSSSECSTVDIAISEEEEMFYGGERSKHLKNGCRRGSSLGQISGASKKGKIWQNIRKTCCKIVENNWFKCFIGLVTLLSTGTLAFEDIYIDQRKTIKILLEYADMIFTYIFILEMLLKWMAYGFKAYFSNGWYRLDFVVVIVFCLSLIGKTREELKPLISMKFLRPLRVLSQFERMKVVVRALIKTTLPTLNVFLVCLMIWLIFSIMGVDLFAGRFYECIDPTSGERFPSSEVMNKSRCESLLFNESMLWENAKMNFDNVGNGFLSLLQVATFNGWITIMNSAIDSVAVNIQPHFEVNIYMYCYFINFIIFGVFLPLSMLITVIIDNFNKHKIKLGGSNIFITVKQRKQYRRLKKLMYEDSQRPVPRPLNKLQGFIFDVVTSQAFNVIVMVLICFQAIAMMIDTDVQSLQMSIALYWINSIFVMLYTMECILKLIAFRCFYFTIAWNIFDFMVVIFSITGLCLPMTVGSYLVPPSLVQLILLSRIIHMLRLGKGPKVFHNLMLPLMLSLPALLNIILLIFLVMFIYAVFGMYNFAYVKKEAGINDVSNFETFGNSMLCLFQVAIFAGWDGMLDAIFNSKWSDCDPDKINPGTQVRGDCGNPSVGIFYFVSYILISWLIIVNMYIVVVMEFLNIASKKKNKTLSEDDFRKFFQVWKRFDPDRTQYIDSSKLSDFAAALDPPLFMAKPNKGQLIALDLPMAVGDRIHCLDILLAFTKRVMGQDVRMEKVVSEIESGFLLANPFKITCEPITTTLKRKQEAVSATIIQRAYKNYRLRRNDKNTSDIHMIDGDRDVHATKEGAYFDKAKEKSPIQSQI

SEQ ID NO: 764238 - protein, 44 aa, Homo sapiens
MPGCNNQFLERHVNQSKPKICNPLTLLETVRKRRYGLDLNSRKY

SEQ ID NO: 764239 - protein, 84 aa, Homo sapiens
FKDINFRRLEANMLEPPFCPDPHAVYCKDVLDIEQFSAVKGIYLDTADEDFYARFATGCVSIPWQNEGCLTMVPSEKEVEPKQC

SEQ ID NO: 764240 - protein, 70 aa, Homo sapiens
GLGCLIYEMIQGHSPFKKYKEKVKWEEVDQRIKNDTEEYSEKFSEDAKSICRMGCLTMVPSEKEVEPKQC

SEQ ID NO: 764241 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 764242 - protein, 2896 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764243 - protein, 2172 aa, Homo sapiens
RGFPKVHSSISAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764244 - protein, 3256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764245 - protein, 3256 aa, Homo sapiens; identical to SEQ ID NO: 764244

SEQ ID NO: 764246 - protein, 3256 aa, Homo sapiens; identical to SEQ ID NO: 764244

SEQ ID NO: 764247 - protein, 1158 aa, Homo sapiens
SPPATLSVCVVSPDVCVSFFRAESTFCTSLFSKGVLGCLLVLVGVSADSGGEDSQGILVVLPAATAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764248 - protein, 639 aa, Homo sapiens
PEVFQKCTLLYLTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764249 - protein, 3256 aa, Homo sapiens; identical to SEQ ID NO: 764244

SEQ ID NO: 764250 - protein, 2257 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRR

SEQ ID NO: 764251 - protein, 2256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTGLDLQCVCLYTPLGVVRCPRVRKNSSTDQGSDEEGSLQK

SEQ ID NO: 764252 - protein, 1960 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKFRARPNFRASPKFRS

SEQ ID NO: 764253 - protein, 689 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKNKISSSDASAN

SEQ ID NO: 764254 - protein, 3256 aa, Homo sapiens; identical to SEQ ID NO: 764244

SEQ ID NO: 764255 - protein, 3089 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKKE

SEQ ID NO: 764256 - protein, 2407 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGENTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764257 - protein, 1529 aa, Homo sapiens
SEMKLPEEGSGSNICCSAIFAVPIFAVPQPLLVIPWKTGSGVELQQTPMDLQLRDLTVRRKANKEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764258 - protein, 3256 aa, Homo sapiens; identical to SEQ ID NO: 764244

SEQ ID NO: 764259 - protein, 1144 aa, Homo sapiens
LRIPDVSLVGRCCACWGCPRGLGGGDWQAIWVVFSSVVGWSVPGVWKSSLKPARSSRAWAFSLGVGGHLWLPGKFPGRSNFCTGVPIKAFRSFSSPPAGWGVSIAFPTDGVRFLDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764260 - protein, 574 aa, Homo sapiens
SPWGVIQGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 764261 - protein, 2936 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPVAYSTSPN

SEQ ID NO: 764262 - protein, 795 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGKNVVLDLINLLTLLFFTVLMFVLLTLFICCERDYKINDSIT

SEQ ID NO: 764263 - protein, 124 aa, Homo sapiens
RLYLAAPSGKWEAPLPGRPVWEVRSTSARPPPRLGSGEHLYLAAPSGKWEAPLPGRPVWEVRSASAQLPPRLGCEERLCLAAPSGKWGAPLPGCPIWEMGSTSARPPHLGSEERLCPADTPSGM

SEQ ID NO: 764264 - protein, 145 aa, Homo sapiens
EAGDILREYKLSDGNVIHIGDQLYQVPEVLFAPDQLGIHSPGLSIMASSNIMNCDTDIQKKVFAEIVLSGGTTLFSGPEERLMKELEQLASKGNNRRNWLFYGGFDWNGVLSFKESNLTYGSNKSPLRKLDSYLSTQSLNRVPDL

SEQ ID NO: 764265 - protein, 112 aa, Homo sapiens
MSQQRHLHADSQWECTPRNTCKNVHSCITHNSPKLDLATCKFPSRRNESILVHPHKGILYSNAKGELPFCIPTQMNLGHHAELKQPNTKECLQIFTYSESGKLINNARSQER

SEQ ID NO: 764266 - protein, 141 aa, Homo sapiens
MQGRAKSRGPEVTPGPGAYSPEKVPPVRHRTPPAFTLGCRLPLKPLDTSAPAPNAYTMPPLWGSQIFTKPSSPSYTVVAAPPPPAPRRILLRYQARASTTARTQTPTASACLPSPCWGGPGPRDPWRRPPALAPTAQSRSP

SEQ ID NO: 764267 - protein, 181 aa, Homo sapiens
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 764268 - protein, 181 aa, Homo sapiens; identical to SEQ ID NO: 764267

SEQ ID NO: 764269 - protein, 243 aa, Homo sapiens
SRVLLRPLSVPLDSCGVQGPGQLGDVRRAWVRVLYPYHEVFPHPQLHLLGRVVLAEAGNASVAGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 764270 - protein, 164 aa, Homo sapiens
MRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 764271 - protein, 181 aa, Homo sapiens; identical to SEQ ID NO: 764267

SEQ ID NO: 764272 - protein, 181 aa, Homo sapiens; identical to SEQ ID NO: 764267

SEQ ID NO: 764273 - protein, 196 aa, Homo sapiens
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVVNIIKAYARYYGRTADEFLHTD

SEQ ID NO: 764274 - protein, 181 aa, Homo sapiens; identical to SEQ ID NO: 764267

SEQ ID NO: 764275 - protein, 181 aa, Homo sapiens; identical to SEQ ID NO: 764267

SEQ ID NO: 764276 - protein, 181 aa, Homo sapiens; identical to SEQ ID NO: 764267

SEQ ID NO: 764277 - protein, 156 aa, Homo sapiens
SQLTLAPAPAWSPTWKLLADWACEETASELQPKAKESLKIGEGGQGVHHGPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 764278 - protein, 194 aa, Homo sapiens
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWQVSCFQKPSVHLCVLAAMHVHV

SEQ ID NO: 764279 - protein, 233 aa, Homo sapiens
RRGRRAWSWRVGSGRAGRPKVSLPASASEWEPGAASRAVGPARPAQQLWKKRDGNTPGNTGKKKKSQVRPRRRGQVCGSRGLCDGLGYDLSPLASHDVPLAATAFPRLLPVPCPRSSGPGVTMGQASDSLISRPQVPLVRHLRGASQYRLRRVLSYLMEASTGMSDGAAGGLAFVPGPPVRGNVQVPEYVAHRRDRAFVLQSTVTAYAQPRGSPSGRDYAGTGPAGDSAGPGW

SEQ ID NO: 764280 - protein, 450 aa, Homo sapiens
AQWDPRPAVVSGTGGHLQRRALDYATEGPLPRLSPGLRHRRIPALPRPAVSWTVHCRTPTLPHPGLWLPRTLAPARPELLLPLSALDCGSRGPGPGATCATAWTPGPQSFHALDQGTGEPLTRRPRPRAPEDPHLAVPRTTARKDPRSAGHWAPAQRDPRHGGLDYPCPTAPWTTARQDPRLNTPYTLAMGEPGPAEPWTLALEDSSARFWTPAPEDSCPATPWTPALENPAPSPPRLWHGRTPATDFGTVRPLTRLALDSSTGGPPATALSGLPLRHRVLHYSTAGPPPTAHWTEAQQHPGLVVGGLQDEVTPRPAARWTMAQEDHHSRMPWTTAGQVPHSAAAWNMALQDPRPAAPRTPPLKTLAPLHPGQRHGRTRLHRPVGYHIGKPPAHPHRARDSDKREPLPPAPRTTARQEPPSSRILTMATVEPRPGTPWTKSPKDPDPTTP

SEQ ID NO: 764281 - protein, 864 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 764282 - protein, 819 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 764283 - protein, 803 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 764284 - protein, 89 aa, Homo sapiens
MDHVSLGINLTSSFHPAYLQQISPVLSPSSTCMDLHKPPGPLVLMVAVVATSTLSLLMVCGVLILGTKRLAGTVDSRLLLSSELGWVSA

SEQ ID NO: 764285 - protein, 734 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGGAWPGPVLASATRCHRGFPSQCYSAQTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 764286 - protein, 109 aa, Homo sapiens [sequence omitted]

SEQ ID NO: 764287 - protein, 105 aa, Homo sapiens
DGVSLCHPGWSAVVRSRLTGTSTSQVQAILCYFPILRGLRGFREARRDFWRGAESLEAALTHNAEVPRRRAQEAEEAGAALRTARAGYRGRALDYALQVPAPICL

SEQ ID NO: 764288 - protein, 768 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSMLLPSSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRGAWGLASQGNGGPLEQKREDCVLLPSHRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 764289 - protein, 733 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSMLLPSSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGKEYTHPTPQAQHLNSGLLVHGDLSP

SEQ ID NO: 764290 - protein, 503 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSMLLPSSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSR

SEQ ID NO: 764291 - protein, 153 aa, Homo sapiens [sequence omitted]

SEQ ID NO: 764292 - protein, 152 aa, Homo sapiens [sequence omitted]

SEQ ID NO: 764293 - protein, 115 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKE

SEQ ID NO: 764294 - protein, 740 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSMLLPSSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 764295 - protein, 756 aa, Homo sapiens
MTVKLDFEECLKDSPRFRQPDGPKLSSHDPLFPRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 764296 - protein, 368 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFKSGSP

SEQ ID NO: 764297 - protein, 136 aa, Homo sapiens
MPPSTPLLDFSMQNSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 764298 - protein, 196 aa, Homo sapiens
WRWGTLYPRPLGHPFFPSLPQGSGHLAIGSAATLGSGGMARGREPGGVGHVVAQVQSVDGNAQCCDCREPAPEWASINLGVTLCIQCSGIHRLLHKAHAGAPLLRATVRLQYRAHHTGPSSFPVLASSLSFWLCHWVPGLGPSLWGASWTQAGLAPLCPSLARIGGYPEFVGLVGRSVGSRLLRVGEPVKTRQRNG

SEQ ID NO: 764299 - protein, 431 aa, Homo sapiens
MCQPRGWWRDPALGTTGANKTFHGSQVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 764300 - protein, 432 aa, Homo sapiens
FGTGGAVGGLGRVVSALVHLVPHGEAVVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 764301 - protein, 752 aa, Homo sapiens
RGGGGGRGGPGARERERPGEPERTMEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYGNKYKRRVPRVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 764302 - protein, 162 aa, Homo sapiens [sequence omitted]

SEQ ID NO: 764303 - protein, 752 aa, Homo sapiens; identical to SEQ ID NO: 764301

SEQ ID NO: 764304 - protein, 752 aa, Homo sapiens; identical to SEQ ID NO: 764301

SEQ ID NO: 764305 - protein, 752 aa, Homo sapiens; identical to SEQ ID NO: 764301

SEQ ID NO: 764306 - protein, 139 aa, Homo sapiens
SSASPFPASQALPSYPHSFPPPTSLSVSNQPPSLAFSPIPGCVEPGSPPPCGSEPRPPHPSLSPPGSREMFVLALSQESQMTFFFSIKEKAPSLPLTSPRPPPLPVPHAAANDSMMLTLLLGNYFYVINVCFLVYKCLI

SEQ ID NO: 764307 - protein, 752 aa, Homo sapiens; identical to SEQ ID NO: 764301

SEQ ID NO: 764308 - protein, 799 aa, Homo sapiens
MSRPPTTRRSAAGPPEALDQTSECRRARRRRIWGKRRRRADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 764309 - protein, 865 aa, Homo sapiens
MSRPPTTRRSAAGPPEALDQTSECRQGAEEEDLGEEEEEGQAHLEDWRGQLSELLNDFEERLEDQERLKPEGQREHSEEPGICEEQNPERERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 764310 - protein, 650 aa, Homo sapiens
LRLGTRLGVHTAILVTGAQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 764311 - protein, 650 aa, Homo sapiens; identical to SEQ ID NO: 764310

SEQ ID NO: 764312 - protein, 555 aa, Homo sapiens
LRLGTRLGVHTAILVTGAQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENWRSPTRLPQRRW

SEQ ID NO: 764313 - protein, 500 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 764314 - protein, 500 aa, Homo sapiens; identical to SEQ ID NO: 764313

SEQ ID NO: 764315 - protein, 443 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKDYSSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 764316 - protein, 144 aa, Homo sapiens
EKASTYRFSEGGHNSVLSTTTGYLIIYFKIKGKTARRGGHQSRLCDIKSGLFSNSKMKKILSTVTMEMIYALVPSPTKSAISELGNGEVWNEQKAETCLLEPHHDHPVSGKPWVELEAADELAALINQDEEKTSPAVRGGAYGG

SEQ ID NO: 764317 - protein, 708 aa, Homo sapiens
MWGAYIKFRNRHDYFKMLEVRILFSKHVFLKICCTFWDSNSFVFGKNSLVPTYPAILLILHTSYLDGVYSNCCCFNLGLVLHRCHHWNINYLVLICLDASTSCVPSVYLADRKVRCGSVINIWCSAYFGIRTMVFLFCFVFFMYTSYINSQIFNLCIGLPEDVALTRGNGSVFIDGSLIKWKFKTYICGSHETVSLSQSWWLTHVIPALWEGETGRSPEVRSLRPAGQHGETLSLLKIQKNYLAWWYVPVIPATQEAEAGESLEPQEAEVVVSWVAPLHSSLVDRVRLCLKKKSFPALICCFILRNLRNDYFKYYSVYKCVISELCKRKPRKNNFLNFLFGEGGVSDPNLLFYKMGKHCQSFLKFEMQNLKFLTALRSRERKPFYTRKVLFKKFDDPEKLIISLVTIMPVSFLPFDLTDIDMSLCECCSFSVFIFYFIGCNLVSDDFLIGCNFLHSIWVLLSLINDLSNLLEALYAKDILIFSKVLRKIIGYVVISPWIYFSNCHCFTFSQVYCSAEGYFHLGYIAQTLGYNYNQYVSMVIIIISMYYNQYVSNHLLSTSSFLFLIANIFVSCYTTVLGFFLKFLLHINYLIYHLALRYILFISILQMRIESRRSLNTCLFLTVRNAETRLKLSSSGCRTCTLKYYFMLHHIMVHDLFLVSVIVMMLENFIVYPFNLLNMDVSLCCQVCLLCHVNFVIVSSLFFTQIL

SEQ ID NO: 764318 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 764319 - protein, 505 aa, Homo sapiens
VTGVEMSEETMLSRPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 764320 - protein, 1144 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 764321 - protein, 116 aa, Homo sapiens [sequence omitted]

SEQ ID NO: 764322 - protein, 1159 aa, Homo sapiens; identical to SEQ ID NO: 764318

SEQ ID NO: 764323 - protein, 1126 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIILLSFQGFFCK

SEQ ID NO: 764324 - protein, 1127 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGASV

SEQ ID NO: 764325 - protein, 1057 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKHERL

SEQ ID NO: 764326 - protein, 905 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQVSLLTFMPVFCHPGGE

SEQ ID NO: 764327 - protein, 56 aa, Homo sapiens
YKCKECGEAFSQSSTLTKHIKVYTGEKPYTCKDCRKAFSQSSSLTQHQRVHTGKKP

SEQ ID NO: 764328 - protein, 73 aa, Homo sapiens
KTLLFGVWTLLALILCPDPGPSGIETFLKKTQVGKGPQWKEFLLEDVTENSILQCFFSCAGIQKDTSLGITVY

SEQ ID NO: 764329 - protein, 919 aa, Homo sapiens
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764330 - protein, 846 aa, Homo sapiens
MEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764331 - protein, 533 aa, Homo sapiens
MPRNNVLPSIWVSVNPVKLQHRIQDQLNKKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764332 - protein, 919 aa, Homo sapiens; identical to SEQ ID NO: 764329

SEQ ID NO: 764333 - protein, 891 aa, Homo sapiens
MTAEETVNVKEVEIIKLILDFLNSKKLHISMLALEKESGVINGLFSDDMLFLRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764334 - protein, 974 aa, Homo sapiens
TLEEPLTLLYFSASSSISLTRALIASSSGASMAPSPVSPSSAAPPGLPWSPQAINMTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764335 - protein, 293 aa, Homo sapiens
LVQVPVALYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 764336 - protein, 589 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGILDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 764337 - protein, 576 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGILDENANLDASCFLNGGLEGSREGSLPGTSVPPSMDAGRSSSVDLSLSSCDSFELLQALPDYSLGPHYTSQKVSDSLSPPGDASSCFLESLMGFSEPAAEALDPFIDSQFEDTVPASLMEPVPV

SEQ ID NO: 764338 - protein, 589 aa, Homo sapiens; identical to SEQ ID NO: 764336

SEQ ID NO: 764339 - protein, 589 aa, Homo sapiens; identical to SEQ ID NO: 764336

SEQ ID NO: 764340 - protein, 576 aa, Homo sapiens; identical to SEQ ID NO: 764337

SEQ ID NO: 764341 - protein, 190 aa, Homo sapiens
WRPGVRQRSEPRSFPLTRRAERRAGLGAGSLPPPPPLPDAQSEGRLDRRLPGRAHRVAAQGASPAGTRVASLSSASVRIAGERRGASGPAGRDFGEGAFSASGTAAPASCRSLPGTLSGRGGWSCPALTACRGRSRGPGARPAGVAGFLLPSPARRGNPERSHGSPSSARVGTEPGLRASGEATGACVRG

SEQ ID NO: 764342 - protein, 259 aa, Homo sapiens
AGPGPGGVWDRRRCRTRRARGGWTDGCRAERTESRRRGRPRPGRGSRRCPPRASGLQAVCPQTPEHVRHHHDWAVEEEEEEGSVGNLDNLSCFHPADIFGTSDPGGLASWTHSYSGCSFTSGILDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 764343 - protein, 589 aa, Homo sapiens; identical to SEQ ID NO: 764336

SEQ ID NO: 764344 - protein, 574 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGILDENANLDASCFLNGGLEGSREGSLPGTSVPPSMDAGRSSSVDLSLSSCDSFELLQALPDYSLGPHYTSQKVSDSLDNIEAPHFPLPGLSPPFRKQLASRLAFSSRTPDVKLQPEELWVQL

SEQ ID NO: 764345 - protein, 421 aa, Homo sapiens
MRGLLVLSVLLGAVFGKEDFVGHQVLRISVADEAQVQKVKELEDLEHLQLDFWRGPAHPGSPIDVRVPFPSIQAVKIFLESHGISYETMIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWRGASDHHGAHPESPLLS

SEQ ID NO: 764346 - protein, 421 aa, Homo sapiens; identical to SEQ ID NO: 764345

SEQ ID NO: 764347 - protein, 100 aa, Homo sapiens
HSALHKAQSFGQGWIVNPTRVNIPKVIDPFSPILLLPQIKPVEALLTGPTARASSTPSPSSSGTLGAMASCCQPPRSSPQPRRRGVALLTIMEHTLNHPY

SEQ ID NO: 764348 - protein, 421 aa, Homo sapiens; identical to SEQ ID NO: 764345

SEQ ID NO: 764349 - protein, 227 aa, Homo sapiens
EDVQGVENGGESCILPVVLVIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWRGASDHHGAHPESPLLS

SEQ ID NO: 764350 - protein, 133 aa, Homo sapiens
HDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 764351 - protein, 141 aa, Homo sapiens
MSLLANDRSGSGGPCPGTEASPGSVPSSSQSWCAQRHRASDSCRPQLWERAGGAAGGACAFLGMSRHERCTCSCSPGRRLSTVRCGVRVHLTICRSPADPRVACRAGVAVRVGKGLKVWVQGAVLGPAGWGVRCEWGAFVV

SEQ ID NO: 764352 - protein, 675 aa, Homo sapiens
MAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 764353 - protein, 2412 aa, Homo sapiens
DLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 764354 - protein, 308 aa, Homo sapiens
MAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQATPHRDRRRAVAAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 764355 - protein, 356 aa, Homo sapiens
SCRLAAGRLAQWLLRASRSGMLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 764356 - protein, 158 aa, Homo sapiens [sequence omitted]

SEQ ID NO: 764357 - protein, 158 aa, Homo sapiens [sequence omitted]

SEQ ID NO: 764358 - protein, 356 aa, Homo sapiens; identical to SEQ ID NO: 764355

SEQ ID NO: 764359 - protein, 192 aa, Homo sapiens
SCRLAAGRLAQWLLRASRSGMLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQAREPAIISSAGQSDWSG

SEQ ID NO: 764360 - protein, 236 aa, Homo sapiens
SCRLAAGRLAQWLLRASRSGMLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLRVH

SEQ ID NO: 764361 - protein, 356 aa, Homo sapiens; identical to SEQ ID NO: 764355

SEQ ID NO: 764362 - protein, 192 aa, Homo sapiens; identical to SEQ ID NO: 764359

SEQ ID NO: 764363 - protein, 192 aa, Homo sapiens; identical to SEQ ID NO: 764359

SEQ ID NO: 764364 - protein, 158 aa, Homo sapiens [sequence omitted]

SEQ ID NO: 764365 - protein, 356 aa, Homo sapiens; identical to SEQ ID NO: 764355

SEQ ID NO: 764366 - protein, 179 aa, Homo sapiens
SCRLAAGRLAQWLLRASRSGMLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQSSLT

SEQ ID NO: 764367 - protein, 356 aa, Homo sapiens; identical to SEQ ID NO: 764355

SEQ ID NO: 764368 - protein, 356 aa, Homo sapiens; identical to SEQ ID NO: 764355

SEQ ID NO: 764369 - protein, 356 aa, Homo sapiens; identical to SEQ ID NO: 764355

SEQ ID NO: 764370 - protein, 142 aa, Homo sapiens
RKGLASQSHSAFIVLKQFQWNGGVGMKPVGKSCCKGENLSFIITLPGPLPHEGTLCASASLPTGGLMCCVLNLQTSPLQALAHHLLPSPSGQARDESLAYEQTNIEENEGVLSHLFIQVAESHSSQSQNSRSFIVRKKEDDI

SEQ ID NO: 764371 - protein, 827 aa, Homo sapiens
HKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKNFTFNDDFSPSSTSSADLSGLGAEPKTPGLSQSLALSSDESLDMIDDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 764372 - protein, 1043 aa, Homo sapiens
HKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 764373 - protein, 1081 aa, Homo sapiens
HKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 764374 - protein, 1081 aa, Homo sapiens; identical to SEQ ID NO: 764373

SEQ ID NO: 764375 - protein, 109 aa, Homo sapiens
IFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNVITLQ

SEQ ID NO: 764376 - protein, 432 aa, Homo sapiens
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQGGGGGSQPPGLNSEQQPPQPPPPPPTLPPSSPTNPGGGVPAKKPKGGPNASSSSATISKQIFPWMKESRQNSKQKNSCATAGESCEDKSPPGPASKRVRTAYTSAQLVELEKEFHFNRYLCRPRRVEMANLLNLTERQIKIWFQNRRMKYKKDQKAKGILHSPASQSPERSPPLGGAAGHVAYSGQLPPVPGLAYDAPSPPAFAKSQPNMYGLAAYTAPLSSCLPQQKRYAAPEFEPHPMASNGGGFASANLQGSPVYVGGNFVESMAPASGPVFNLGHLSHPSSASVDYSCAAQIPGNHHHGPCDPHPTYTDLSAHHSSQGRLPEAPKLTHL

SEQ ID NO: 764377 - protein, 432 aa, Homo sapiens; identical to SEQ ID NO: 764376

SEQ ID NO: 764378 - protein, 140 aa, Homo sapiens
CGHPIGIAHYSPELLGSSHPPASASRVAGITGARHRARLVFSLLPCNATYSWVPRIEIGCLWEPLLGPSHLSMLKSPRIKETALLERAIVNQELQESGLRGTAWGPQGMAAMRGVGPESDDSFGGLGRKEAERSENHSEE

SEQ ID NO: 764379 - protein, 50 aa, Homo sapiens
MSLGTITRPITSEYVEVTEDQGDSTAGEGDSEPGTTRVRTERNGLGPTGN

SEQ ID NO: 764380 - protein, 293 aa, Homo sapiens
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 764381 - protein, 293 aa, Homo sapiens; identical to SEQ ID NO: 764380

SEQ ID NO: 764382 - protein, 293 aa, Homo sapiens; identical to SEQ ID NO: 764380

SEQ ID NO: 764383 - protein, 183 aa, Homo sapiens
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQVCESYI

SEQ ID NO: 764384 - protein, 293 aa, Homo sapiens; identical to SEQ ID NO: 764380

SEQ ID NO: 764385 - protein, 293 aa, Homo sapiens; identical to SEQ ID NO: 764380

SEQ ID NO: 764386 - protein, 240 aa, Homo sapiens
GSTPKPGEAGSEVGTPGESSVSVAGSHLAAVQDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 764387 - protein, 293 aa, Homo sapiens; identical to SEQ ID NO: 764380

SEQ ID NO: 764388 - protein, 112 aa, Homo sapiens [sequence omitted]

SEQ ID NO: 764389 - protein, 674 aa, Homo sapiens
VKWSGRAEGAKVRVLVPRSRREPRLRRATPSLALGAQHPADKRRDARTRRARSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 764390 - protein, 655 aa, Homo sapiens
MPLKWKTSSPAIWKFPVPVLKTSRSTPLSPAYISLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 764391 - protein, 668 aa, Homo sapiens
IIQLLEVMDHLHRGELVAAILRNRRRRQLSLKQADFKDIFKKSTSGSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 764392 - protein, 604 aa, Homo sapiens
MGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 764393 - protein, 184 aa, Homo sapiens
MKTFGRSSSWYSAQDGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 764394 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764395 - protein, 1190 aa, Homo sapiens
VLTHLKFDQTLRMLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764396 - protein, 1178 aa, Homo sapiens; identical to SEQ ID NO: 764394

SEQ ID NO: 764397 - protein, 1178 aa, Homo sapiens; identical to SEQ ID NO: 764394

SEQ ID NO: 764398 - protein, 1190 aa, Homo sapiens
SCSLSVEAAAVEAAARTGDGEEIVSAFWRADQTLRMLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764399 - protein, 1213 aa, Homo sapiens
SCSLSVEAAAVEAAARTGDGEEIVSAFWRADQTLRMLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764400 - protein, 1240 aa, Homo sapiens
SCSLSVEAAAVEAAARTGDGEEIVSAFWRADQTLRMLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKVLSPPGPARRWGLAGPRMYVPSALCLQEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764401 - protein, 267 aa, Homo sapiens
GVPGVRDSSTGVNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764402 - protein, 168 aa, Homo sapiens
MGGSPNPFALRDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 764403 - protein, 1085 aa, Homo sapiens
SCSLSVEAAAVEAAARTGDGEEIVSAFWRADQTLRMLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKLLCDLGSLQEEASIQAIQGAKDGSEVLEV

SEQ ID NO: 764404 - protein, 1213 aa, Homo sapiens; identical to SEQ ID NO: 764399

SEQ ID NO: 764405 - protein, 1213 aa, Homo sapiens; identical to SEQ ID NO: 764399

SEQ ID NO: 764406 - protein, 189 aa, Homo sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 764407 - protein, 108 aa, Homo sapiens
MFPFLSLLSDWTSGRRQLLALLQWFKNVRIAVTTILLAFLSWSPNDCWSFSHHISDQGSWIQAVIQTLGSPTQGLLLLSHWSSLSERKAVKYSIINKHVAGSNNIESC

SEQ ID NO: 764408 - protein, 82 aa, Homo sapiens
KTDIQCGRLQSLLLHSWQTWIIDHCTLPAEPTQGLRDLFHPELQAVPTYGLPLRGNIIVVGNWEPLHVLEQENGCQNRFCVP

SEQ ID NO: 764409 - protein, 207 aa, Homo sapiens
MVSHSSWEAGPWAPWQPGSALRSQLRCQCLGLPRRYCSGVGWAPPFTSSWSLGAGPPVEPGSWQTSSMSDVETRPSWIRVGPGPVTGDRLRERGGGSEMHRSGTSHEDRPETGVCGHAPEAPEPPGAGGGCAGSSPEPLEGACPGHLNVGLLAAELRGNTSLAVVNHPGCGNLLWPPCDASIPPSLMSGAKAGRVKYLGLKALGFLR

SEQ ID NO: 764410 - protein, 71 aa, Homo sapiens
QGRHLPSVWVRAAGLQAPFPPLPRWVRAKCRPLVSTILLCQASVWTQNAFLCCLPQVPPCFQPHLSRSVST

SEQ ID NO: 764411 - protein, 97 aa, Homo sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 764412 - protein, 97 aa, Homo sapiens; identical to SEQ ID NO: 764411

SEQ ID NO: 764413 - protein, 104 aa, Homo sapiens
PVNSLSDFSSQMPFQGRQLQNPNGSLGRGHTLSSRTTSDSLLLPSPSWTQAPREPSEDWFTCSAAPLPATPQGWRLAPLHVALALQDSDDPQVTVMTLPGPRTS

SEQ ID NO: 764414 - protein, 128 aa, Homo sapiens
MRHLLEPFGVTLSGPSATVSTPGSWVLSSPSQDIFRPGLSELLLLLIIETGCQSIAKTGVQWCDPGLLSLPGSGDPPSSASCVAGTTGRHHHAWLNIFVFFVETSSRYVVQVGLKLLPQPPKVLGLQA

SEQ ID NO: 764415 - protein, 105 aa, Homo sapiens
MKDEVLNLNSQLLYAIWKKVKLECSGPILAHCNLCLLGSRHPSTSASQVAGTTGEKTMRSARMMDCHHWGTGKGLSKSMYVFQSLQNVSDSLKYIFSKCQVSMQC

SEQ ID NO: 764416 - protein, 126 aa, Homo sapiens [sequence omitted]

SEQ ID NO: 764417 - protein, 862 aa, Homo sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWDPSPTQAKESPVAAGEAGPDWFPEGQEEDGGLCPPLNQSSPTSKEGGTLPAPVGSPEDPSDPPQPYRLADDYTPAPAAFQGLSLSSHMSLLHSRNSCKTLKCPKCNWHYKYQQTLDVHMQEKHPESNSHCSYCSAGGAHPRLARGESYNCGYKPYRCDVCNYSTTTKGNLSIHMQSDKHLANLQGFQAGPGGQGSPTEASLPPSAGDKEPKTKSSWQCKVCSYETNISRNLRIHMTSEKHMQNVLMLHQGLPLGLPPGLMGPGPPPPPGATPTSPPELFQYFGPQALGQPQTPLAGPGLRPDKPLEAQLLLNGFHHVGAPARKFPTSAPGSLSPDAHLPPSQLLGSSSDSLPTSPPPDDSLSLKVFRCLVCQAFSTDSLELLLYHCSIGRSLPEAEWKEVAGDTHRCKLCCYGTQLKANFQLHLKTDKHAQKYQLAAHLREGGGAMGTPSPASLGDGAPYGSVSPLHLRCNICDFESNSKEKMQLHARGAAHEENSQIYKRTGTGLLIK

SEQ ID NO: 764418 - protein, 436 aa, Homo sapiens
MSLMVVSMACVGLFLVQRAGPHMGGQDKPLLSAWPSLVVLLEDMSFFGVTLILGLTTSVCKRKVGCTVPELHNRIFWNSLFMGPVTPAHTGTYRCRGSHTHSPSGWSAPSNPLVIVVIGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 764419 - protein, 320 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKMLLELTKTLGERTVDREASDEPDPQEGDYARGFLVFPKKFSLLGREP

SEQ ID NO: 764420 - protein, 341 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 764421 - protein, 243 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 764422 - protein, 306 aa, Homo sapiens
SLAGRGRASPSAESILTRSVPRASYGDDLREHAGSGRTLKPRRAMETYAEVGKEGKPSCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRECLPAGRPVMRAHKCLADDYIPISAALSSLGTQEVNQLRT

SEQ ID NO: 764423 - protein, 321 aa, Homo sapiens
SLAGRGRASPSAESILTRSVPRASYGDDLREHAGSGRTLKPRRAMETYAEVGKEGKPSCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRECLPAGRPVMRAHKCTQGPRGPGSPCPSPQRFNSLGERREQGVPCCLSVATSTKA

SEQ ID NO: 764424 - protein, 361 aa, Homo sapiens
SLAGRGRASPSAESILTRSVPRASYGDDLREHAGSGRTLKPRRAMETYAEVGKEGKPSCASVDLQGDSSLQVEISDAVSERDKVKFTVQTKSCLPHFAQTEFSVVRQHEEFIWLHDAYVENEEYAGLIVRRGWAGAGRDRQSTWVRTKGCDGRLGSERPPSSVPAFEQIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRECLPAGRPVMRAHKCTQGPRGPGSPCPSPQRFNSLGERREQGVPCCLSVATSTKA

SEQ ID NO: 764425 - protein, 414 aa, Homo sapiens
SLAGRGRASPSAESILTRSVPRASYGDDLREHAGSGRTLKPRRAMETYAEVGKEGKPSCASVDLQGDSSLQVEISDAVSERDKVKFTVQTKSCLPHFAQTEFSVVRQHEEFIWLHDAYVENEEYAGLIVRRGWAGAGRDRQSTWVRTKGCDGRLGSERPPSSVPAFEQIPPAPPRPDFEASREKLQKLGEGDSSVTREEFAKMKQELEAECPLLSLPSPESRCLPQLSPHECLATLTSDPRKGAGRMMGAEEGLVSCCHSRREYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRECLPAGRPVMRAHKCTQGPRGPGSPCPSPQRFNSLGERREQGVPCCLSVATSTKA

SEQ ID NO: 764426 - protein, 141 aa, Homo sapiens
MHEVFLQRLAAHPTLRRDHNFFVFLEYGQDLSVRGKNRKELLGGFLRNIVKSADEALITGMSGLKEVDDFFEHERTFLLEYHTRIRECLPAGRPVMRAHKCTQGPRGPGSPCPSPQRFNSLGERREQGVPCCLSVATSTKA

SEQ ID NO: 764427 - protein, 113 aa, Homo sapiens
MRWSASVCFCVCLCVYSLHVSVSLCVCVYVDVPAYVCVCVYLCMSVFVSLCVCVSVCVSVCVCVFVCLCVSVCVSVCLRVSVCVCMACVCLCVCTYASMWVFVRACLCLSLCV

SEQ ID NO: 764428 - protein, 69 aa, Homo sapiens
SLCRRWGFRAESDTAPVLKEPTLRLKPRRPCLSSFAPYLLSSLKAGVLAEGGDAQPILPQGPSPRLPHF

SEQ ID NO: 764429 - protein, 390 aa, Homo sapiens
QKRKIYNVCPRKGKKIFIHMHEIIQIDGHIYQCLECKQNFCENLALIMCERTHTGEKPYKSDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 764430 - protein, 390 aa, Homo sapiens; identical to SEQ ID NO: 764429

SEQ ID NO: 764431 - protein, 299 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNLPEFYTSSVFSELIHTTQTSVCALDEKINLAFSIQPFFFPVPLLHIYTWRQKKKSGAPNKGAEISQKVNPGYQ

SEQ ID NO: 764432 - protein, 237 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNSLNFYTSSVFL

SEQ ID NO: 764433 - protein, 237 aa, Homo sapiens; identical to SEQ ID NO: 764432

SEQ ID NO: 764434 - protein, 236 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNSLNFIHLQFL

SEQ ID NO: 764435 - protein, 256 aa, Homo sapiens
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNSLNFYTSSVFL

SEQ ID NO: 764436 - protein, 247 aa, Homo sapiens
DSTQGPEQPSTHSSASLLCCSPAAPSCPSVLTRLLIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNTLNFYTSSVFL

SEQ ID NO: 764437 - protein, 181 aa, Homo sapiens
MQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNLPEFYTSSVFSELIHTTQTSVCALDEKINLAFSIQPFLYYMIKNLNIIITLV

SEQ ID NO: 764438 - protein, 253 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEADPDGFEFLETLKAVAQIALKTQILASSGLTLMTSPCVVPYWEKTCDIDLSGPQIGVVMWLVRMRLVATGRWEDCFCWELRLAEVSGGGHRGGRVCAVWAFRRVGA

SEQ ID NO: 764439 - protein, 123 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEEVKKTPMAASTTKLLSSTSCLSEWSSQEQALFRKDWLENLF

SEQ ID NO: 764440 - protein, 87 aa, Homo sapiens
RRVPTRENGRRSLQAKGPISLSSTSCLSEWSSQNKHCLGKTGWKTYFNHTHDKLSRSVYHHSRKTKAIWDGSRLSNSLNFYTSSVFL

SEQ ID NO: 764441 - protein, 140 aa, Homo sapiens
MQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNSLNFYTSSVFL

SEQ ID NO: 764442 - protein, 150 aa, Homo sapiens
CLDGSLAGAMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNSLNFYTSSVFL

SEQ ID NO: 764443 - protein, 256 aa, Homo sapiens; identical to SEQ ID NO: 764435

SEQ ID NO: 764444 - protein, 237 aa, Homo sapiens; identical to SEQ ID NO: 764432

SEQ ID NO: 764445 - protein, 237 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFCQAHHVYLNGALKNKHCLGKTGWKTYFNHTHDKLSRSVYHHSRKTKAIWDGSRLSNTLNFYTSSVFL

SEQ ID NO: 764446 - protein, 161 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNDKLSRSVYHHSRKTKAIWDGSRLSNSLNFYTSSVFL

SEQ ID NO: 764447 - protein, 117 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQLNLHLTKVPCKKCPFKQSFSGYII

SEQ ID NO: 764448 - protein, 256 aa, Homo sapiens; identical to SEQ ID NO: 764435

SEQ ID NO: 764449 - protein, 237 aa, Homo sapiens; identical to SEQ ID NO: 764432

SEQ ID NO: 764450 - protein, 133 aa, Homo sapiens
DSTQGPEQPSTHSSASLLCCSPAAPSCPSVLTRLLIEFSKEQQDEFKEAFLLFDRTGDSKITLSQVGDVLRALGTNPTNAEVRKVLGNPSNEELNAKKIEFEQFLPMKTLLRVCVSLTRKAMAQSWVLNSAMF

SEQ ID NO: 764451 - protein, 237 aa, Homo sapiens; identical to SEQ ID NO: 764445

SEQ ID NO: 764452 - protein, 177 aa, Homo sapiens
LDSGTGAALNSLFSFPAVLQPSRSIMSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEHTMTHEERSGSPDGRSRRLQWLHQLRSFVKHIMSI

SEQ ID NO: 764453 - protein, 157 aa, Homo sapiens
DSTQGPEQPSTHSSASLLCCSPAAPSCFCQAHHVYLNGALKNKHCLGKTGWKTYFNHTHDKLSRSVYHHSRKTKAIWDGSRLSNLPEFYTSSVFSELIHTTQTSVCALDEKINLAFSIQPFFFPVPLLHIYTWRQKKKSGAPNKGAEISQKVNPGYQ

SEQ ID NO: 764454 - protein, 559 aa, Homo sapiens
AALLNLLQTPVPRPHRFSSREPYKDIGKMSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 764455 - protein, 559 aa, Homo sapiens; identical to SEQ ID NO: 764454

SEQ ID NO: 764456 - protein, 566 aa, Homo sapiens
AALLNLLQTPVPRPHRFSSREPYKDIGKMSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMVQVFSAQSGG

SEQ ID NO: 764457 - protein, 698 aa, Homo sapiens
AALLNLLQTPVPRPHRFSSREPYKDIGKMSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNIKSVVPSVTTWDPDLCLIAPFLQEEAALVFWEDHRPSPSPSPHSSLCVTHSSVLRHLLSFLLTWSPFHPLWDVFPTCLHPASSSVPSDVGVIAAHEEDSSTVSLTVVHFVLIFGSSILELFPKLLCLDGQQSPRATLCGTEAHKRLPTCKVRREDPAGWCMRKGGTICGPGDSLFQGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 764458 - protein, 672 aa, Homo sapiens
AALLNLLQTPVPRPHRFSSREPYKDIGKMSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNIKSVVPSVTTWDPDLCLIAPFLQEEAALVFWEDHRPSPSPSPHSSLCVTHSSVLRHLLSFLLTWSPFHPLWDVFPTCLHPASSSVPSDVGVIAAHEEDSSTVSLTVVHFVLIFGSSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 764459 - protein, 192 aa, Homo sapiens [sequence omitted]

SEQ ID NO: 764460 - protein, 350 aa, Homo sapiens
AALLNLLQTPVPRPHRFSSREPYKDIGKMSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNIKSVVPSVTTWDPDLCLIAPFCRRRQH

SEQ ID NO: 764461 - protein, 176 aa, Homo sapiens
VQGHVTPLQKDTSSWRCLHWQTTHSCSSFSSRSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 764462 - protein, 161 aa, Homo sapiens
LKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 764463 - protein, 370 aa, Homo sapiens
GNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFAVIAKKSKVTLSSLMEELVLKSNYTDSFFEFQVVEGPPRFIKGISDCYAPIGTAAYFQCLVRGSPRPTVYWYKDGKLVQGRRFTVEESGTGFHNLFITSLVKSDEGEYRCVATNKSGMAESFAALTLT

SEQ ID NO: 764464 - protein, 244 aa, Homo sapiens
GNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFNR

SEQ ID NO: 764465 - protein, 77 aa, Homo sapiens
GSSGQALGQRRHSRSSSAFRKVFLAGALRVRASVLEALSKPPLHQRHPSGVRKEGAFPLSPSLWTVTKQAIRSPNTY

SEQ ID NO: 764466 - protein, 165 aa, Homo sapiens
MGKRRCVPPLEPKLAAGCCGVKKPKLSGSGTHSHGNQSTTVPGSSSGPLQNHQHVDSSSGRENVSDLTLGPGNSPITRMNPASGALSPLPRPNGTANTTKNLVVTAEMCCYCFDVLYCHLYGFPQPRLPRFTNDPYPDLCDVEGQGGDKTRYEDWEMGRTNHKER

SEQ ID NO: 764467 - protein, 165 aa, Homo sapiens; identical to SEQ ID NO: 764466

SEQ ID NO: 764468 - protein, 165 aa, Homo sapiens; identical to SEQ ID NO: 764466

SEQ ID NO: 764469 - protein, 264 aa, Homo sapiens
YILEPGEYPTSEAWGTSDPSVGSLKPMRLGCPSVEKPGEPRAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPSTQAIHVLSGVWVAYQEVGFSGEQYVLEKGVYRNCEDWGAGNSTLASLQPVLQVRAGRGGRGLPGGGTWSSGAPRPHAEVAGWRTCLGAWGGALEGGGA

SEQ ID NO: 764470 - protein, 1059 aa, Homo sapiens
MVAMRPPRSVVHSEELELYISYKGKLWKGLAGEKYDLINNFKADFGYLVEIECWWKVNLRIEAGRGNCPGKMLEIWSRAVVLNLSCGCLRSFLIVFSFFFFFFCKRLGSQYVAKFVLNSESLKDSSASTSQIARTAGTIPPCLTKNLNAYSFTPGHLNRTFLRLAQEEDLLKFHRQFQCAVKTEDCWCRGMAGELCGVINLKYILQVQQTGVANTLNFSGKWGEKGLSFLAFINELIVSFTKTGKLNIEKENQEFCFEYVEFEMPISHSSGEGLHSSGESSYDVSLELREEIPVRDENVSGWHKVGLKVKNRLSSCWESINKEKEPLAEAGGTPGEDYDKGEKNLKKRLQTASEVGYCGVPEAKGEVVSLEEKLQLAGLKMTAVKYSEVQRGIEFSKINAVDDLDNLKWWRKKSEWSKLRKRMTEKTFKRKSKWEMRKIYIANFFEIVGVLFVVNVAGKKMELIGRRQGRTKNMWVIFVCFGFVFEAIDENISVERLGTVEVLEKVKGDEDSYHKWGGFEESRNSSILETMYVGADRFGEKMKRRKKEPESWSEQMDKNDVRINSEAILLTIYDSALIWFISDFDSFSSLFLIDFRCSLFWRGYPKYHRYFFSFSEYLKDCVRRTIFRWNSAYWFIQHCLINRYWTLGIQRGGRHSLCLKGSPSLMEKLCPNETLTCFAFLFRLKDSKISANKAFLRKLMRNLVINEQKLSMRWGGVKHVLSGELRITNSCMPRSWPVFLFKHNKTSHQIRYELEPTFYESFASTSPPLLVYWWKEDYQKYPEDHLNFYLVTFLLNDFEDLKQYFNLSIMYTAKKPCLITYLISTLGQVDLLHYWDFALDQVSLDIVVPISLSCVSAGNMLLALWRVEQNQLSDIITLVAKCSLEIQEKFGIYHTREGQDLQLKKVVPPKRVIQLGKGEPTIKTSKDEMINWEKMFAIHIDKGRIALLGKEHLEIKKTIVLLREKLDKGHEEIVYRQGNACLLTRKKMINIHNKKNANWKYTDYLSYLIDRQNFRCWTMYSLVSLRNELFLTVSEQRYKVIWQSLFIFIVYCIFYVNKN

SEQ ID NO: 764471 - protein, 206 aa, Homo sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPASPGLYPAATTAKQGKTGAEAPPLPGTSQYGHERTSQYTGTSPHPATSPPAGSSRPPMQLDSTSAEDTSPALSSGSSKPR

SEQ ID NO: 764472 - protein, 240 aa, Homo sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPR

SEQ ID NO: 764473 - protein, 77 aa, Homo sapiens
PGMVLFSAARRALGISFPKHKNTGTQEEQLEDNSVGTETGTAQSADLTGSAGPPWCFTTCILLLRMPLQLSFLGFYD

SEQ ID NO: 764474 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 764475 - protein, 131 aa, Homo sapiens; identical to SEQ ID NO: 764474

SEQ ID NO: 764476 - protein, 131 aa, Homo sapiens; identical to SEQ ID NO: 764474

SEQ ID NO: 764477 - protein, 113 aa, Homo sapiens
LGSVIVEEGAVTGKVSTMARSLVCLGVIILLSAFSGPGVRGGPMPKLADRKLCADQECSHPISMAVALQDYMAPDCRFLTIHRGQVVFREITMEIWLLAWAISPVALSERTRP

SEQ ID NO: 764478 - protein, 77 aa, Homo sapiens
LGSVIVEEGAVTGKVSTMARSLVCLGVIILLSAFSGPGVRGGPMPKLADRKLCADQECSRSGRLLWRSGCSPGLFPQ

SEQ ID NO: 764479 - protein, 228 aa, Homo sapiens
VLCGCSKAKSVGRLCVPGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 764480 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 764481 - protein, 450 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTRKSTS

SEQ ID NO: 764482 - protein, 712 aa, Homo sapiens
MENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764483 - protein, 717 aa, Homo sapiens
RRDQTQLRPGHTWTECCQIPHLYPDLSLRGVPTQLVDGDTVTFDPKVLAGTSRTLALGRELRVSGGPGCLPVGAASACPSGKPTPSFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764484 - protein, 518 aa, Homo sapiens
PLRIRPLLPTAYHLLPTGPGQSADRSEQRGGPCPPAMPRSSQFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764485 - protein, 712 aa, Homo sapiens
MQRYRGRQTVFGAGVLGGVSSAPSFNTPSPRSSPLFYPSAPSGHRQLLGVGPTLSPSSTFYRFSTSGADSSSLSPPLPALGRTREQTLLGARSRGRVLLPAIPDPFLWRMENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764486 - protein, 463 aa, Homo sapiens
PLRIRPLLPTAYHLLPTGPGQSADRSEQRGGPCPPAMPRSSQFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764487 - protein, 791 aa, Homo sapiens
GTQAGLRSGAPSGHRQLLGVGPTLSPSSTFYRFSTSGADSSSLSPPLPALGRTREQTLLGARSRGRVLLPAIPDPFLWRMENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764488 - protein, 700 aa, Homo sapiens
AVQKRSRAAGARSSLHAVLAMQGPPAPAPVPGPGSPRGSPRGSPGLFRKLLVNQSIRLQRRFTVAHPLCFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764489 - protein, 1088 aa, Homo sapiens
MQRYRGRQTVFGAGVLGGVSSAPSFNTPSPRSSPLFYPSAPSGHRQLLGVGPTLSPSSTFYRFSTSGADSSSLSPPLPALGRTREQTLLGARSRGRVLLPAIPDPFLWRMENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKYVEGGAGRGRGRQRQGGRKAGCKLRLGLRRLQVGLRGGAWWTWGRGEMGGAATPEAAVTAGRDPSETLHPAISSLLQVKYLFLPSPAEDSWELPFHSDLPSPGAPYTGANCSPAPAKTITPSGMDPTTLILQMRRLRPRDLMVTQALGEQIWNLGPGVLGGPRGNSFRVQMKRRSRERRGVPERGGWAGPWLPRLPEDTGQKLALETLDELDWCLDQLETLQTRHSVGEMASNKFKRILNRELTHLSETSRSGNQVSEYISRTFLVAMGFHRIAQTGLELLTSSDLPTSTSQSTGITGVSHCVRPTGSLLRTYFGSCRKGNRLILGFGKIQVLRPGPSSEIGFSELHPGPSADQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 764490 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764491 - protein, 183 aa, Homo sapiens; identical to SEQ ID NO: 764490

SEQ ID NO: 764492 - protein, 183 aa, Homo sapiens; identical to SEQ ID NO: 764490

SEQ ID NO: 764493 - protein, 183 aa, Homo sapiens; identical to SEQ ID NO: 764490

SEQ ID NO: 764494 - protein, 183 aa, Homo sapiens; identical to SEQ ID NO: 764490

SEQ ID NO: 764495 - protein, 218 aa, Homo sapiens
HWGRGRGSRGYWGSQSGLRPLGVVSGFAGPASLISMKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764496 - protein, 183 aa, Homo sapiens; identical to SEQ ID NO: 764490

SEQ ID NO: 764497 - protein, 183 aa, Homo sapiens; identical to SEQ ID NO: 764490

SEQ ID NO: 764498 - protein, 183 aa, Homo sapiens; identical to SEQ ID NO: 764490

SEQ ID NO: 764499 - protein, 231 aa, Homo sapiens
MPCKAGYNSTEFWGEKLPEIPRKTWFLHGKCEPERVDADINSSRSGKVVSIEPLKKSHEPDLADQLRCPWSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764500 - protein, 183 aa, Homo sapiens; identical to SEQ ID NO: 764490

SEQ ID NO: 764501 - protein, 121 aa, Homo sapiens
HRWPKTSNGFLALAPDNGSLARRSLPQVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764502 - protein, 151 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVHHLLIYHVPWWVALDAPNIGLSLELLGRTPSGSRKSPGCITTWKPNLGTKCTGRRTKLHGD

SEQ ID NO: 764503 - protein, 183 aa, Homo sapiens; identical to SEQ ID NO: 764490

SEQ ID NO: 764504 - protein, 183 aa, Homo sapiens; identical to SEQ ID NO: 764490

SEQ ID NO: 764505 - protein, 208 aa, Homo sapiens
MKLLSLVAVVGCLLVPPAEANKVREVSLQHLVTTTVHGHPVYRADSESSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764506 - protein, 190 aa, Homo sapiens
MKLLSLVAVVGCLLVPPAEANKSSEDIRCKCICPPYRNISGHIYNQNVSQKDCPVSLCCSNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 764507 - protein, 195 aa, Homo sapiens
MHRIMGENVDFYTVLAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764508 - protein, 291 aa, Homo sapiens
MTSLIGFYTLTRTTHHAYPDPGQTIIATHTGLDMNVRTTWRIMSIKCLGVLYSLEGTFYEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764509 - protein, 144 aa, Homo sapiens
LLLLNSRPDTSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764510 - protein, 90 aa, Homo sapiens
MKGKLARSTKEIPDEISILLLGVAHFKGQWVTKFDSRKTSLEDFYLDEERTVRVPMMSDPKAVLRYGLDSDLSCKIAQLALDPACFSFFL

SEQ ID NO: 764511 - protein, 390 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764512 - protein, 390 aa, Homo sapiens; identical to SEQ ID NO: 764511

SEQ ID NO: 764513 - protein, 455 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGLMPLTYFRKISKDENSLATKIVLKISLLGLSADKKDEYSVCVLGGGLIWGPGVQLSTSTSLSLAGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764514 - protein, 463 aa, Homo sapiens
LSSLQPLPPWFKEFSCLSLQSSWDYRHLPSCPANFCIFSRDGVSPCCLGWSQTPGLKRSTRLGLPKCWDYRREPPRLARIILRAMMGEVQGLVPLTPSLPPPGLMPLTYFRKISKDENSLATKIVLKISLLGLSADKKDEYSVCVLGGGLIWGPGVQLSTSTSLSLAGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764515 - protein, 374 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMSMSEDPFALGGWMGWGRVFGPSTVLSRTQGLHRLVGGPWMSP

SEQ ID NO: 764516 - protein, 148 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKS

SEQ ID NO: 764517 - protein, 274 aa, Homo sapiens
GSAHRLLYGVLVLTPRGVPPCLPPKAAGITELRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764518 - protein, 358 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITASGVVWSDVPV

SEQ ID NO: 764519 - protein, 274 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKINQLPLPEYRGV

SEQ ID NO: 764520 - protein, 35 aa, Homo sapiens
MKGKLARSTKEIPDEISILLLGVAHFKGERVSNSF

SEQ ID NO: 764521 - protein, 144 aa, Homo sapiens; identical to SEQ ID NO: 764509

SEQ ID NO: 764522 - protein, 390 aa, Homo sapiens; identical to SEQ ID NO: 764511

SEQ ID NO: 764523 - protein, 234 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLD

SEQ ID NO: 764524 - protein, 69 aa, Homo sapiens
HRLVKVIVQREGEVGRLQPWAGGGSRPILVPLKAFPLDYHLNQPFIFVLRDTDTGALLFIGKILDPRGP

SEQ ID NO: 764525 - protein, 390 aa, Homo sapiens; identical to SEQ ID NO: 764511

SEQ ID NO: 764526 - protein, 390 aa, Homo sapiens; identical to SEQ ID NO: 764511

SEQ ID NO: 764527 - protein, 326 aa, Homo sapiens
LADPLIGSHPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764528 - protein, 183 aa, Homo sapiens
MQALVLLLCIGALLGHSSCQNPASPPEEGSPDPDSTGALVEEEDPFFKVPVNKLAAAVSNFGYDLYRVRSSMSPTTNVLLSPLSVATALSALSLGAEQRTESIIHRALYYDLISSPDIHGTYKELLDTVTAPQKNLKSASRIVFEKKLRIKSSFVAPLAARDQQLGAGADEREARQVHKGNSR

SEQ ID NO: 764529 - protein, 347 aa, Homo sapiens
SSRILFDGVCNMETGETCISANPLNVPRKHWWTDSSAEKKHVWFGESMDGGFQFSYGNPELPEDVLDVQLAFLRLLSSRASQNTVEASTGVLPASTSQSAGITELRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764530 - protein, 270 aa, Homo sapiens
MDPKAVLRYGLDSDLSCKIAQLPFDRKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPQPRAAACPPHLPAGLSP

SEQ ID NO: 764531 - protein, 114 aa, Homo sapiens [sequence omitted]

SEQ ID NO: 764532 - protein, 398 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764533 - protein, 339 aa, Homo sapiens
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764534 - protein, 356 aa, Homo sapiens
AGVLLARFNMGLSCSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764535 - protein, 355 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764536 - protein, 293 aa, Homo sapiens
MLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764537 - protein, 338 aa, Homo sapiens
MSVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764538 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764539 - protein, 182 aa, Homo sapiens
STSSTRAIDAPSFVPELLRIHRVPETIASTVPTQAETLGPLSSISEPPWPDPGQGNDPFRRQPEHLSVEFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764540 - protein, 253 aa, Homo sapiens
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKRTFDMNKTKL

SEQ ID NO: 764541 - protein, 351 aa, Homo sapiens; identical to SEQ ID NO: 764538

SEQ ID NO: 764542 - protein, 354 aa, Homo sapiens
MSARKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764543 - protein, 354 aa, Homo sapiens; identical to SEQ ID NO: 764542

SEQ ID NO: 764544 - protein, 346 aa, Homo sapiens
MSACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 764545 - protein, 233 aa, Homo sapiens [sequence omitted]

SEQ ID NO: 764546 - protein, 312 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKRTFDMNKTKL

SEQ ID NO: 764547 - protein, 312 aa, Homo sapiens; identical to SEQ ID NO: 764546

SEQ ID NO: 764548 - protein, 142 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 764549 - protein, 171 aa, Homo sapiens
LGGAGVQEGRLDQAGQKRTGLRVSTRARDMRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 764550 - protein, 188 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGWSWGNGLGSGGVHGHRPGGKLWEASPRDTRQGPWVLPWAEHVSSCRMCEGEKRKLVIPSELGYGERGAPPKIPGGATLVFEVELLKIERRTEL

SEQ ID NO: 764551 - protein, 423 aa, Homo sapiens
WGEPGCKRAGWIRPGRSGPGSECQRELGDEEIGGGGRSCPEMPQGEGSHAARGGVLGLGAGRGTGTGGTSELVPVEGGARRRGAELGGSGDGAWLLKEELEEVKGGASGSEAEGDGAEALGAGLQPVSGVATAPEKGSSSVEGGAAGPGAVPRPPKGGAKEPSEEPGPSNGPGRPRGGGLRGGRAWGRRRPRTPPGEVVWVERARRPADTGPVWVPRRPPRAQSWGGAPGGSTGPGWGVSPEDPGSSEPPSGDVWVPRGRPPGSGRRGVGVLDRGQLGVADMRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 764552 - protein, 129 aa, Homo sapiens [sequence omitted]

SEQ ID NO: 764553 - protein, 130 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGGATLVFEVELLKIERRTEL

SEQ ID NO: 764554 - protein, 109 aa, Homo sapiens
VSVAPEPGGEGGDPGQRGSPGARKIQWRWNPPVTYPCSILSLPSPTFSRSVGVCAHRDMRLSWFRVLTVLSICLSAVATATGAEGKRKLQIGVKKRVDHCPIKSRKGDV

SEQ ID NO: 764555 - protein, 98 aa, Homo sapiens
TRECLGVWFSISQGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 764556 - protein, 142 aa, Homo sapiens; identical to SEQ ID NO: 764548

SEQ ID NO: 764557 - protein, 122 aa, Homo sapiens
MRLSWFRVLTVLSICLSAVATATGAEGKRKWPSHVPQGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 764558 - protein, 306 aa, Homo sapiens
WGEPGCKRAGWIRPGRSGPGSECQRELGDEEIGGGGRSCPEMPQGEGSHAARGGVLGLGAGRGTGTGGTSELVPVEGGARRRGAELGGSGDGAWLLKEELEEVKGGASGSEAEGDGAEALGAGLQPVSGVATAPEKGSSSVEGGAAGPGAVPRPPKGGAKEPSEEPGPSNGPGRPRGGGLRGGRAWGRRRPRTPPGEVVWVERARRPADTGPVWVPRRPPRAQSWGGAPGGSTGPGWGVSPEDPGSSEPPSGDVWVPRGRPPAAAAEVLVCWTGGSWVWREWGRPVGATAVQPDRVWTLRKGTGGN

SEQ ID NO: 764559 - protein, 193 aa, Homo sapiens
SFLPSFSSSYSSPRFFSSSPLSPLLFLLLLLFSFPPPLLHLFISSSFFCSRFSSSPFSSSSPLPCPLLLLVHLLYSSFSSSSFSSFPPFLFFSSSPPPLVLFSFPHSFLLLLLLFSPYFLLASLFSSPLLVLLSPSPFFLHFLSSYYLLLIFSSSSSLSSSFSSLLLLLFLHSSTPTPSLTVPLAMPNSTQHK

SEQ ID NO: 764560 - protein, 1140 aa, Homo sapiens [sequence omitted]

SEQ ID NO: 764561 - protein, 130 aa, Homo sapiens
HSNFAVFPAVPEPFGGAIIIGQESITYHNGDKYLAIAPPIIKQSTIVCHNRVDPNGSRYLLGDMEGRLFMLLLEKEEQMDGTVTLKDLRVELLGEVELVLPVPLQCSFRFLKTPNVWSHTSTLGIMLLNT

SEQ ID NO: 764562 - protein, 1140 aa, Homo sapiens [sequence omitted]

SEQ ID NO: 764563 - protein, 1140 aa, Homo sapiens [sequence omitted]

SEQ ID NO: 764564 - protein, 1146 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQSSAVIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764565 - protein, 923 aa, Homo sapiens
MVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764566 - protein, 970 aa, Homo sapiens
AYGSIFAYLLCLQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764567 - protein, 773 aa, Homo sapiens
FGHRRGRLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764568 - protein, 700 aa, Homo sapiens
MARGSWMISRLSSVATWLISSLSSHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764569 - protein, 1140 aa, Homo sapiens [sequence omitted]

SEQ ID NO: 764570 - protein, 1140 aa, Homo sapiens [sequence omitted]

SEQ ID NO: 764571 - protein, 812 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEDLLHCGHSNGVS

SEQ ID NO: 764572 - protein, 1140 aa, Homo sapiens [sequence omitted]

SEQ ID NO: 764573 - protein, 1100 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764574 - protein, 1140 aa, Homo sapiens [sequence omitted]

SEQ ID NO: 764575 - protein, 614 aa, Homo sapiens
RVHLDSVVVSELACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764576 - protein, 987 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSMTMAAV

SEQ ID NO: 764577 - protein, 1140 aa, Homo sapiens [sequence omitted]

SEQ ID NO: 764578 - protein, 1041 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSDSTLTIGTIDEIQKLHIRTVPLYESPRKICYQEVSQCFGEGWEFLGLWWMQALGSVSGSGAPVYRDRTFLVREEKVTEIHLFETGSPTVEYVSSPGKLSTVTTARGPVSGPVVETGGSESDFLTAFSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764579 - protein, 365 aa, Homo sapiens
ALSLQKLVGMKHFKGVLVNDKYGCALLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764580 - protein, 352 aa, Homo sapiens
ASCRIGTRHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764581 - protein, 681 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNLVFSTWASLSMSFATALW

SEQ ID NO: 764582 - protein, 1082 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKT

SEQ ID NO: 764583 - protein, 224 aa, Homo sapiens
IEISTVDGDKHGALYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764584 - protein, 702 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLTIGTIDEIKKLTLPPLDRTGESTVIPNRQ

SEQ ID NO: 764585 - protein, 671 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNSALKGTSS

SEQ ID NO: 764586 - protein, 557 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEQALVSTSRLVTTSLLEGTVTNF

SEQ ID NO: 764587 - protein, 342 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGEVELVLPVPLQCSFRFLKTPNVWSHTSTLGIMLLNT

SEQ ID NO: 764588 - protein, 300 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEASASTFSCFQGPLLNSFSRRDTS

SEQ ID NO: 764589 - protein, 39 aa, Homo sapiens
PPVGEHPLGPHSPAHLLIAYDDGSGMKREATADDLIKVV

SEQ ID NO: 764590 - protein, 257 aa, Homo sapiens
MSLQAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFLADPFTPCLSHPVP

SEQ ID NO: 764591 - protein, 77 aa, Homo sapiens
MQNRLNKVIKSVGKIEHSFWRSFHTERKTEPATGFIDGDLIESFLDISRPKMQEVVANLQYDGVRGALFILKSELMT

SEQ ID NO: 764592 - protein, 1140 aa, Homo sapiens [sequence omitted]

SEQ ID NO: 764593 - protein, 1140 aa, Homo sapiens [sequence omitted]

SEQ ID NO: 764594 - protein, 1140 aa, Homo sapiens [sequence omitted]

SEQ ID NO: 764595 - protein, 694 aa, Homo sapiens
MISRLSSVATWLISSLSSHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764596 - protein, 682 aa, Homo sapiens
RLGRGRGVIGRGITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764597 - protein, 1140 aa, Homo sapiens [sequence omitted]

SEQ ID NO: 764598 - protein, 669 aa, Homo sapiens
RLGRGRGESAEAKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764599 - protein, 1140 aa, Homo sapiens [sequence omitted]

SEQ ID NO: 764600 - protein, 1140 aa, Homo sapiens [sequence omitted]

SEQ ID NO: 764601 - protein, 434 aa, Homo sapiens
TRLGTRLGGSLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764602 - protein, 1140 aa, Homo sapiens [sequence omitted]

SEQ ID NO: 764603 - protein, 531 aa, Homo sapiens
MIDLSWYLNIVSLNSDGYPDSLALANNSTLTIGTIDEIQKLHIRTVPLYESPRKICYQEVSQCFGVLSSRIEVQDTSGGTTALRPSDSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764604 - protein, 356 aa, Homo sapiens
GSYPVHYTAVANTAFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764605 - protein, 1086 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFLADPFTPCLSHPVP

SEQ ID NO: 764606 - protein, 738 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPSSPSSPPSSSWPWEAFP

SEQ ID NO: 764607 - protein, 249 aa, Homo sapiens
ALPMCEKPVNCDRSLNCNRPLYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFWRSFHTERKTEPATGFIDGDLIESFLDISRPKMQEVVANLQYDDGSGMKREATADDLIKVVEELTRIH

SEQ ID NO: 764608 - protein, 673 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNQKRNKYSINL

SEQ ID NO: 764609 - protein, 601 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELFIYRPGTVAMPVIPEFGRPRQHTGT

SEQ ID NO: 764610 - protein, 417 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGSFFGGHRM

SEQ ID NO: 764611 - protein, 266 aa, Homo sapiens
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKNMAQSMDLWEPW

SEQ ID NO: 764612 - protein, 348 aa, Homo sapiens
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQLGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 764613 - protein, 69 aa, Homo sapiens
VKAVDGPEFPGAAVAAAVVPASPPPPPRLIPWLAALAGRGTVVVDARPCLREDTTLNEQRLNFVYRYLL

SEQ ID NO: 764614 - protein, 259 aa, Homo sapiens
MKHSKKTYDSFQDELEDYIKVQKARGLEPKTCFRKMKGDYLETCGYKGEVNSRPTYRMFDQRLPSETIQTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF

SEQ ID NO: 764615 - protein, 259 aa, Homo sapiens; identical to SEQ ID NO: 764614

SEQ ID NO: 764616 - protein, 259 aa, Homo sapiens; identical to SEQ ID NO: 764614

SEQ ID NO: 764617 - protein, 259 aa, Homo sapiens; identical to SEQ ID NO: 764614

SEQ ID NO: 764618 - protein, 259 aa, Homo sapiens; identical to SEQ ID NO: 764614

SEQ ID NO: 764619 - protein, 199 aa, Homo sapiens
LYGSPVLHHTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF

SEQ ID NO: 764620 - protein, 259 aa, Homo sapiens; identical to SEQ ID NO: 764614

SEQ ID NO: 764621 - protein, 109 aa, Homo sapiens
MMGHRPVLVLSQNTKRESGRKVQSGNINAAKTIADIIRTCLGPKSMMKMLLDPMGGIVMTNDGNAILREIQVQHPAAKSMIEISRTQDERGWRWDHISNYSCRGNAVCS

SEQ ID NO: 764622 - protein, 198 aa, Homo sapiens
VVSGIPGMFCPGSLSPEGSAGSPSSGYPALHRVAMMGHRPVLVLSQNTKRESGRKVQSGNINAAKTIADIIRTCLGPKSMMKMLLDPMGGIVMTNDGNAILREIQVQHPAAKSMIEISRTQDERGWRWDHISNYSCWALLFVNFLEQTMPPPVVIRYRPVIGSAPPPPAPPTRHFVSTLMPLIPSTSYNTALRRRSYD

SEQ ID NO: 764623 - protein, 109 aa, Homo sapiens; identical to SEQ ID NO: 764621

SEQ ID NO: 764624 - protein, 165 aa, Homo sapiens
MNEVGDGTTSVIILAGEMLSVAEHFLEQQMHPTVVISAYRKALDDMISTLKKISIPVDISDSDMMLNIINSSITTKAISRWSSLACKHLPWMLSKHGTSLTDEWSATRRLTITHNTLCNEWDTKDTGGSLRTRVCGGSVNGVCPSRFGVFRPPGGGSLGEQGGPG

SEQ ID NO: 764625 - protein, 206 aa, Homo sapiens
MEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQEEL

SEQ ID NO: 764626 - protein, 206 aa, Homo sapiens; identical to SEQ ID NO: 764625

SEQ ID NO: 764627 - protein, 206 aa, Homo sapiens; identical to SEQ ID NO: 764625

SEQ ID NO: 764628 - protein, 206 aa, Homo sapiens; identical to SEQ ID NO: 764625

SEQ ID NO: 764629 - protein, 188 aa, Homo sapiens
MEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEALEVIPRTLIQNCGASTIRLLTSLRAKHTQEEL

SEQ ID NO: 764630 - protein, 206 aa, Homo sapiens; identical to SEQ ID NO: 764625

SEQ ID NO: 764631 - protein, 206 aa, Homo sapiens; identical to SEQ ID NO: 764625

SEQ ID NO: 764632 - protein, 282 aa, Homo sapiens
MEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSSGKTPGDCETGVDWWDGSSGLRTGLGARGSCDLDGEGAGKGWDLLPKGPKAGVGHEEGRVKRALERKGEKGAPQKCVAKKSRRLRP

SEQ ID NO: 764633 - protein, 109 aa, Homo sapiens; identical to SEQ ID NO: 764621

SEQ ID NO: 764634 - protein, 206 aa, Homo sapiens; identical to SEQ ID NO: 764625

SEQ ID NO: 764635 - protein, 206 aa, Homo sapiens; identical to SEQ ID NO: 764625

SEQ ID NO: 764636 - protein, 109 aa, Homo sapiens; identical to SEQ ID NO: 764621

SEQ ID NO: 764637 - protein, 109 aa, Homo sapiens; identical to SEQ ID NO: 764621

SEQ ID NO: 764638 - protein, 109 aa, Homo sapiens; identical to SEQ ID NO: 764621

SEQ ID NO: 764639 - protein, 109 aa, Homo sapiens; identical to SEQ ID NO: 764621

SEQ ID NO: 764640 - protein, 109 aa, Homo sapiens; identical to SEQ ID NO: 764621

SEQ ID NO: 764641 - protein, 165 aa, Homo sapiens; identical to SEQ ID NO: 764624

SEQ ID NO: 764642 - protein, 109 aa, Homo sapiens; identical to SEQ ID NO: 764621

SEQ ID NO: 764643 - protein, 135 aa, Homo sapiens
VVSGIPGMFCPGSLSPEGSAGSPSSGYPALHRVAMMGHRPVLVLSQNTKRESGRKVQSGNINAAKTIADIIRTCLGPKSMMKMLLDPMGGIVMTNDGNAILREIQVQHPAAKSMIEISRTQDERGWRWDHISNYS

SEQ ID NO: 764644 - protein, 114 aa, Homo sapiens
MMGHRPVLVLSEFWGCQEMDPLFALFCPYFSVLPQLRPPLTGPLSLPIIVFILEAQCPAFLSSLNLFASLHKLKLALFSPSLFPGRVLVLGSSFPLRVLSLSPHASPAPAPFLA

SEQ ID NO: 764645 - protein, 109 aa, Homo sapiens; identical to SEQ ID NO: 764621

SEQ ID NO: 764646 - protein, 170 aa, Homo sapiens
MNEVGDGTTSVIILAGEMLSVAEHFLEQQMHPTVVISAYRKALDDMISTLKKISIPVDISDSDMMLNIINSSITTKAISRWSSLACKHLPWMLSKHGTSLTDEWSATRRLTITHNTLCNEWDTQFAEWEDPGAHEDPVCGAVNGWPSRWGLLRTRGGVFRVHEGSGVVRG

SEQ ID NO: 764647 - protein, 282 aa, Homo sapiens; identical to SEQ ID NO: 764632

SEQ ID NO: 764648 - protein, 109 aa, Homo sapiens; identical to SEQ ID NO: 764621

SEQ ID NO: 764649 - protein, 125 aa, Homo sapiens
MLSVAEHFLEQQMHPTVVISAYRKALDDMISTLKKISIPVDISDSDMMLNIINSSITTKAISRWSSLACKHLPWMLSKHGTSLTDEWSATRRLTITHNTLCNEWDTKIPGRHHLEELLCLGRWES

SEQ ID NO: 764650 - protein, 109 aa, Homo sapiens; identical to SEQ ID NO: 764621

SEQ ID NO: 764651 - protein, 206 aa, Homo sapiens; identical to SEQ ID NO: 764625

SEQ ID NO: 764652 - protein, 206 aa, Homo sapiens; identical to SEQ ID NO: 764625

SEQ ID NO: 764653 - protein, 206 aa, Homo sapiens; identical to SEQ ID NO: 764625

SEQ ID NO: 764654 - protein, 206 aa, Homo sapiens; identical to SEQ ID NO: 764625

SEQ ID NO: 764655 - protein, 206 aa, Homo sapiens; identical to SEQ ID NO: 764625

SEQ ID NO: 764656 - protein, 206 aa, Homo sapiens; identical to SEQ ID NO: 764625

SEQ ID NO: 764657 - protein, 109 aa, Homo sapiens; identical to SEQ ID NO: 764621

SEQ ID NO: 764658 - protein, 206 aa, Homo sapiens; identical to SEQ ID NO: 764625

SEQ ID NO: 764659 - protein, 206 aa, Homo sapiens; identical to SEQ ID NO: 764625

SEQ ID NO: 764660 - protein, 206 aa, Homo sapiens; identical to SEQ ID NO: 764625

SEQ ID NO: 764661 - protein, 116 aa, Homo sapiens
KLVRAGVNRQRACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQEEL

SEQ ID NO: 764662 - protein, 109 aa, Homo sapiens; identical to SEQ ID NO: 764621

SEQ ID NO: 764663 - protein, 114 aa, Homo sapiens
MMGHRPVLVLTRTQSVNLEYKKEKATDIEITREEDFTRILQMEEEYIQQLCEDIIQLKPDVVITEKGISDLAQHYLMRANITAIRRVRKTDNNRIARALGPRLVTDPGTLESLC

SEQ ID NO: 764664 - protein, 88 aa, Homo sapiens
RSGDGANAGGLVAAIAPKGSEKAAKASRSVAGSKKEKENSSSKSKKGEAKEWGLVQKRILGSSSQFPRSWLLAWMDTYRTSNSGIVRD

SEQ ID NO: 764665 - protein, 1287 aa, Homo sapiens
RSGDGANAGGLVAAIAPKGSEKAAKASRSVAGSKKEKENSSSKARGRSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764666 - protein, 1309 aa, Homo sapiens
RSGDGANAGGLVAAIAPKGSEKAAKASRSVAGSKKEKENSSSKARGRSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLERVSDVEAHAGHSRARRNLRAIWFLRLGAINLVIAAVDAHSKTICSVHSFVLYIDMIGHPPGFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764667 - protein, 1086 aa, Homo sapiens
MLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764668 - protein, 1048 aa, Homo sapiens
RSGDGANAGGLVAAIAPKGSEKAAKASRSVAGSKKEKENSSSKARGRSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764669 - protein, 1287 aa, Homo sapiens; identical to SEQ ID NO: 764665

SEQ ID NO: 764670 - protein, 1287 aa, Homo sapiens; identical to SEQ ID NO: 764665

SEQ ID NO: 764671 - protein, 817 aa, Homo sapiens
RSGDGANAGGLVAAIAPKGSEKAAKASRSVAGSKKEKENSSSKARGRSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPIQPKPTVMGEPFTVNPALTPAKDKKKKD

SEQ ID NO: 764672 - protein, 701 aa, Homo sapiens
MGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764673 - protein, 838 aa, Homo sapiens
AVLGDVLSSSHLISSSFEATDDIQPNSSVYKYMILYSSVYNLHVGQYKLCFLVTHILFEGPLAMGGYLFLRPWNNTSKPLLIQSPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 764674 - protein, 298 aa, Homo sapiens
RSGDGANAGGLVAAIAPKGSEKAAKASRSVAGSKKEKENSSSKARGRSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQTTNIGVRS

SEQ ID NO: 764675 - protein, 143 aa, Homo sapiens [sequence omitted]

SEQ ID NO: 764676 - protein, 1354 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 764677 - protein, 1354 aa, Homo sapiens; identical to SEQ ID NO: 764676

SEQ ID NO: 764678 - protein, 1354 aa, Homo sapiens; identical to SEQ ID NO: 764676

SEQ ID NO: 764679 - protein, 1379 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTSHVRYPVAWQVCTARRWHLEPPFPFS

SEQ ID NO: 764680 - protein, 1284 aa, Homo sapiens [sequence omitted]

SEQ ID NO: 764681 - protein, 1240 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFVMPVPNLSGMFLSHPLP

SEQ ID NO: 764682 - protein, 912 aa, Homo sapiens [sequence omitted]

SEQ ID NO: 764683 - protein, 891 aa, Homo sapiens
MKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 764684 - protein, 784 aa, Homo sapiens
MSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 764685 - protein, 408 aa, Homo sapiens [sequence omitted]

SEQ ID NO: 764686 - protein, 143 aa, Homo sapiens [sequence omitted]

SEQ ID NO: 764687 - protein, 197 aa, Homo sapiens [sequence omitted]

SEQ ID NO: 764688 - protein, 143 aa, Homo sapiens [sequence omitted]

SEQ ID NO: 764689 - protein, 143 aa, Homo sapiens [sequence omitted]

SEQ ID NO: 764690 - protein, 171 aa, Homo sapiens [sequence omitted]

SEQ ID NO: 764691 - protein, 185 aa, Homo sapiens
IKKSFIFAERHFQPESGAPSGSLNLRDGGRLPCPTPSLPSLVDWSLSPANLVAGWGFRANNPPFSFLLDPAPLKSFVPTERFLFEPRRVEERLGLSAEVGKAPAPTEGGTQEASQDLICLQCQIDGLALASDYLQLRWMFTGTQPEFASLHFIPERTCFPHFTFGEDTSNCGHTQKRLPAPFDVS

SEQ ID NO: 764692 - protein, 193 aa, Homo sapiens
LSATRRATRRPQPWVLGLRGRGGCARTCGAGRERRLPGPALDTEPRWDPHRLCEALRAPGRRHEGAGQPRATSGGPASPPGRSRDPWGHISGCGDPPGAFRGSGRNCQGHLEPGPASVGLQGTPGWLRCALAGRPGAAAAEFAGIAGPPPLPPAACSAPGSRPTWTHWAPWSPTCRRRCCPLCSTWACSSSMC

SEQ ID NO: 764693 - protein, 125 aa, Homo sapiens
MRGGSEWLHPAPLKSFVPTERFLFEPRRVEERLGLSAEVGKAPAPTEGGTQEASQDLICLQCQIDGLALASDYLQLRWMFTGTQPEFASLHFIPERTCFPHFTFGEDTSNCGHTQKRLPAPFDVS

SEQ ID NO: 764694 - protein, 103 aa, Homo sapiens
MPPQLVGGTIWTGMVPQEETLPCLRGLPAPLKSFVPTERFLFEPRRVEERLGLSAEVGKAPAPTEGGTQEASQDLICLQCQIDGLALASDYLQLRFTSDGPVC

SEQ ID NO: 764695 - protein, 1042 aa, Homo sapiens
PTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSTSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 764696 - protein, 112 aa, Homo sapiens
MGSSSPAFRKAQPGTELCLALGQRGPGGIRCRPSPRLHLTISPHLQRMSVNPGALHRAAGLQGTAANPRIKAEAILLTIHSCFSPKSIHNRTVKLMFPLLLQTIVKMIGICP

SEQ ID NO: 764697 - protein, 111 aa, Homo sapiens
PPLFFSYSKAMQQKAQEIKKEKIDIGLHQNEKLLCFKGNGKKVKKQLREWKKIFSNHHLTKVVLVCSGCCNKISFQVTRWLKQQIQLALRIHGFQAFDFNQPQIKNIFKTQ

SEQ ID NO: 764698 - protein, 171 aa, Homo sapiens
MGPTAGCRSSTMRLPSSSSWFTLCSWLSSSCCLKCWGRVGWGAAVRTRMALVAPAWPQPLPADLVFPPHARRVGHEVAPVLLQDAALLLRQGAQLPRAALQCVYRLPRLCPRHDAALCAQDPPPAAGWGERKWGAKGAIGRRSGTLAPGRVRAATQAHLQPPCPTLPPAHQ

SEQ ID NO: 764699 - protein, 515 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 764700 - protein, 325 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLAKFSFVILKYE

SEQ ID NO: 764701 - protein, 180 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVRIRIPNPCATDWYGSMAC

SEQ ID NO: 764702 - protein, 526 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLIINICCNLTVQMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 764703 - protein, 320 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLVSMLLH

SEQ ID NO: 764704 - protein, 1465 aa, Homo sapiens
MSLVTVPFYQKRHRHFDQSYRNIQTRYLLDEYASKKRASTQASSQKSLSQRSSSQRASSQTSLGGTICRVCAKRVSTQEDEEQENRSRYQSLVAAYGEAKRQRFLSELAHLEEDVHLARSQARDKLDKYAIQQMMEDKLAWERHTFEERISRAPEILVRLRSHTVWERMSVKLCFTVQGFPTPVVQWYKDGSLICQAAEPGKYRIESNYGVHTLEINRADFDDTATYSAVATNAHGQVSTNAAVVVRRFRGDEEPFRSVGLPIGLPLSSMIPYTHFDVQFLEKFGVTFRREGETVTLKCTMLVTPDLKRVQPRAEWYRDDLLLKESKWTKMFFGEGQASLSFSHLHKDDEGLYTLRIVSRGGVTDHSAFLFVRDADPLVTGAPGAPMDLQCHDANRDYVIVTWKPPNTTTESPVMGYFVDRCEVGTNNWVQCNDAPVKICKYPVTGLFEGRSYIFRVRAVNSAGISRPSRVSDAVAALDPLDLRRLQAVHLEGEKEIAIYQDDLEGDAQVPGPPTGVHASEISRNYVVLSWEPPTPRGKDPLMYFIEKSVVGSGTWQRVNAQTAVRSPRYAVFDLMEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVDQTTTASRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDALYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 764705 - protein, 333 aa, Homo sapiens
MGKSSGACGFMRYRVWIHEVANTKKETVFKWLKDDALYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 764706 - protein, 1368 aa, Homo sapiens
MSLVTVPFYQKRHRHFDQSYRNIQTRYLLDEYASKKRASTQASSQKSLSQRSSSQRASSQTSLGGTICRVCAKRVSTQEDEEQENRSRYQSLVAAYGEAKRQRFLSELAHLEEDVHLARSQARDKLDKYAIQQMMEDKLAWERHTFEERISRAPEILVRLRSHTVWERMSVKLCFTVQGFPTPVVQWYKDGSLICQAAEPGKYRIESNYGVHTLEINRADFDDTATYSAVATNAHGQVSTNAAVVVRRFRGDEEPFRSVGLPIGLPLSSMIPYTHFDVQFLEKFGVTFRREGETVTLKCTMLVTPDLKRVQPRAEWYRDDLLLKESKWTKMFFGEGQASLSFSHLHKDDEGLYTLRIVSRGGVTDHSAFLFVRDADPLVTGAPGAPMDLQCHDANRDYVIVTWKPPNTTTESPVMGYFVDRCEVGTNNWVQCNDAPVKICKYPVTGLFEGRSYIFRVRAVNSAGISRPSRVSDAVAALDPLDLRRLQAVHLEGEKEIAIYQDDLEGDAQVPGPPTGVHASEISRNYVVLSWEPPTPRGKDPLMYFIEKSVVGSGTWQRVNAQTAVRSPRYAVFDLMEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVDQTTTASRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDALYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKFSSFILFV

SEQ ID NO: 764707 - protein, 109 aa, Homo sapiens [sequence omitted]

SEQ ID NO: 764708 - protein, 206 aa, Homo sapiens [sequence omitted]

SEQ ID NO: 764709 - protein, 513 aa, Homo sapiens
MKRLLLLFLFFITFSSAFPLVRMMENEENVQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 764710 - protein, 513 aa, Homo sapiens; identical to SEQ ID NO: 764709

SEQ ID NO: 764711 - protein, 106 aa, Homo sapiens
RTIKRAAGFWARPRFSSVPLRVFLLIGNSCFSLPRNGPQLLLLACWLLCLCRLLQMQRVQMHLLQEELLLLLPCGLCQVCPGLHLQRDVRQVQLLCLMPGQLCSQM

SEQ ID NO: 764712 - protein, 101 aa, Homo sapiens
AGHTTTFAATSSVPLRVFLLIGNSCFSLPRNGPQLLLLACWLLCLCRLLQMQRVQMHLLQEELLLLLPCGLCQVCPGLHLQRDVRQVQLLCLMPGQLCSQM

SEQ ID NO: 764713 - protein, 105 aa, Homo sapiens
SSRINAECPLRPGTSSVPLRVFLLIGNSCFSLPRNGPQLLLLACWLLCLCRLLQMQRVQMHLLQEELLLLLPCGLCQVCPGLHLQRDVRQVQLLCLMPGQLCSQM

SEQ ID NO: 764714 - protein, 106 aa, Homo sapiens; identical to SEQ ID NO: 764711

SEQ ID NO: 764715 - protein, 106 aa, Homo sapiens; identical to SEQ ID NO: 764711

SEQ ID NO: 764716 - protein, 106 aa, Homo sapiens; identical to SEQ ID NO: 764711

SEQ ID NO: 764717 - protein, 115 aa, Homo sapiens
KQSYQRRVSITAGDFICPAACFPLDRELLLLLASKWTPTAPARLLAPVPVPAPANAKSANAPPARRVSAGPSLRIWGMGQVRAGNPELCRQGQANDQLPQTPPSTPDSESDLKLP

SEQ ID NO: 764718 - protein, 106 aa, Homo sapiens; identical to SEQ ID NO: 764711

SEQ ID NO: 764719 - protein, 105 aa, Homo sapiens; identical to SEQ ID NO: 764713

SEQ ID NO: 764720 - protein, 106 aa, Homo sapiens; identical to SEQ ID NO: 764711

SEQ ID NO: 764721 - protein, 106 aa, Homo sapiens; identical to SEQ ID NO: 764711

SEQ ID NO: 764722 - protein, 115 aa, Homo sapiens; identical to SEQ ID NO: 764717

SEQ ID NO: 764723 - protein, 115 aa, Homo sapiens; identical to SEQ ID NO: 764717

SEQ ID NO: 764724 - protein, 138 aa, Homo sapiens [sequence omitted]

SEQ ID NO: 764725 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 764726 - protein, 314 aa, Homo sapiens; identical to SEQ ID NO: 764725

SEQ ID NO: 764727 - protein, 314 aa, Homo sapiens; identical to SEQ ID NO: 764725

SEQ ID NO: 764728 - protein, 314 aa, Homo sapiens; identical to SEQ ID NO: 764725

SEQ ID NO: 764729 - protein, 925 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLQIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 764730 - protein, 872 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLQIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPGPTPPGLL

SEQ ID NO: 764731 - protein, 912 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLQIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPGAPRDWVWGGSGMGVGERDRRPRLKFHSCWHAESSGLWEGGVAVSISL

SEQ ID NO: 764732 - protein, 826 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLQIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKVRPPWRLVPDGTTRLPCPLVAMWASTGACGSGVRVLGWGWAWGCAQ

SEQ ID NO: 764733 - protein, 262 aa, Homo sapiens [sequence omitted]

SEQ ID NO: 764734 - protein, 80 aa, Homo sapiens
PSSKFRHAQGTVLHRDSHITNLKGLNLTTPGESDGFCANKLRVAVPLLSSGGQVAVLEVRAPPHQGCPSVPCLWQRRGGP

SEQ ID NO: 764735 - protein, 981 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLQIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWVSSEWPHFPAGSAVPRTCHGACLLPSQALLTPSHLLVFRPRTSLRPRHLHLTCAATS

SEQ ID NO: 764736 - protein, 925 aa, Homo sapiens; identical to SEQ ID NO: 764729

SEQ ID NO: 764737 - protein, 925 aa, Homo sapiens; identical to SEQ ID NO: 764729

SEQ ID NO: 764738 - protein, 132 aa, Homo sapiens
MSPLHSCLPVGTSTSSGPLAVPRDCFHLCCLWGQLLLISCPLACGQGCRVAGGQQHVPGQALGTLSPLVSLLTWAGPSLDWPHPGSLVTPRCPILPAVPVLVKGLGGWPPTRPSRAAPVSGPWDQLPYFPGL

SEQ ID NO: 764739 - protein, 154 aa, Homo sapiens
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 764740 - protein, 154 aa, Homo sapiens; identical to SEQ ID NO: 764739

SEQ ID NO: 764741 - protein, 144 aa, Homo sapiens
MRSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 764742 - protein, 154 aa, Homo sapiens; identical to SEQ ID NO: 764739

SEQ ID NO: 764743 - protein, 154 aa, Homo sapiens; identical to SEQ ID NO: 764739

SEQ ID NO: 764744 - protein, 134 aa, Homo sapiens
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKLAQSTRTLQG

SEQ ID NO: 764745 - protein, 120 aa, Homo sapiens
MGGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKVRRGF

SEQ ID NO: 764746 - protein, 144 aa, Homo sapiens; identical to SEQ ID NO: 764741

SEQ ID NO: 764747 - protein, 110 aa, Homo sapiens
PSYGSHSVNGPPVVVFHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 764748 - protein, 154 aa, Homo sapiens; identical to SEQ ID NO: 764739

SEQ ID NO: 764749 - protein, 153 aa, Homo sapiens
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEENPGIML

SEQ ID NO: 764750 - protein, 136 aa, Homo sapiens
MGSLSGLRLAAGSCFRLCERDVSSSLRLTRSSDLKRINGFCTKPQESPGAPSRTYNRVPLHKPTDWQKKILIWSGRFKNKMRVKISYLMIALTVVGCIFMVIEGKKAAQRHETLTSLNLEKKARLKEEAAMKAKTE

SEQ ID NO: 764751 - protein, 69 aa, Homo sapiens
HEIHLSSLICPIPSNKEICYLMIALTVVGCIFMVIEGKKAAQRHETLTSLNLEKKARLKEEAAMKAKTE

SEQ ID NO: 764752 - protein, 306 aa, Homo sapiens
RDRVAMWWAGFLTMAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIASTPLGLVTIILGVFMLHAFKDLDISCASLPHMHKNPPPSPAPEPTVIRLEDKNVLVDNIELASTSSPEEKPKVFIIHS

SEQ ID NO: 764753 - protein, 439 aa, Homo sapiens
FSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVDGGFGYLKDAMWWAGFLTNGCWRSCQLWSLRICTCNIVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIASTPLGLVTIILGVFMLHAFKDLDISCASLPHMHKNPPPSPAPEPTVIRLEDKNVLVDNIELASTSSPEEKPKVFIIHS

SEQ ID NO: 764754 - protein, 306 aa, Homo sapiens; identical to SEQ ID NO: 764752

SEQ ID NO: 764755 - protein, 420 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAV

SEQ ID NO: 764756 - protein, 248 aa, Homo sapiens
EGQPEQKTHTTFKCLSCVKVLKNVKFMNHVKHHLEFEKQRNDSWENHTTCQHCHRQFPTPFQLQCHIENVHTAQEPSTVCKICELSFETDQVLLQHMKDHHKPGEMPYVCQVCHYRSSVFADVETHFRTCHENTKNLLCPFCLKIFKTATPYMCHYRGHWGKSAHQCSKCRLQFLTFKEKMEHKTQCHQMFKKPKQLEGLPPETKVTIQVSLEPLQPGSVDVASITVSTSDSEPSLPRSKSKISKKSH

SEQ ID NO: 764757 - protein, 393 aa, Homo sapiens [sequence omitted]

SEQ ID NO: 764758 - protein, 236 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVWFATGVSGRRG

SEQ ID NO: 764759 - protein, 236 aa, Homo sapiens; identical to SEQ ID NO: 764758

SEQ ID NO: 764760 - protein, 66 aa, Homo sapiens
MGQVGPDFLTASCFSFPILSSGNLLGRNSFEVRVCACPGRDRRTEEENLRKKGEPHHELPPGSTKR

SEQ ID NO: 764761 - protein, 112 aa, Homo sapiens
MPRTSLQGIKDQDTTPSSHTHLRPGRGLCVPHCPIGCSGLCLRELGFGEMSISEVLEWPVWQWPLRVGWVLRPIPDTSPAEPSGCSPHQGVTEGYTGLDFWCEEGASTSPVV

SEQ ID NO: 764762 - protein, 112 aa, Homo sapiens; identical to SEQ ID NO: 764761

SEQ ID NO: 764763 - protein, 112 aa, Homo sapiens; identical to SEQ ID NO: 764761

SEQ ID NO: 764764 - protein, 112 aa, Homo sapiens; identical to SEQ ID NO: 764761

SEQ ID NO: 764765 - protein, 187 aa, Homo sapiens
QHLLCLGSALVVIGHLVEVFIVPFFTLGLTLLQQRLQAFLSRPALVVVADQQDDVVPAVDTHHLKPHAGLVGERTVLEVPTPWSRIMKGEHTSTQMCHALAWGLCVHRQGTRCVCADPRVPGHVKRTCVCIVCVCTLCVHCVCMWPNRCDLPEHSTPPPLPELRQPSSPLSCVCVSVATCVTPGGLS

SEQ ID NO: 764766 - protein, 112 aa, Homo sapiens; identical to SEQ ID NO: 764761

SEQ ID NO: 764767 - protein, 702 aa, Homo sapiens
MFIFAVFPNSSDFASNDIFVSPAFLKQHKEIENRMALLDFSLMSCDPCPKLPISVYPHRVLILSKKLAHNSYVTLPSSLNFNTLRFKKIKSHSVDTRMRDARQGRLSQALQTKPARPLSNLLLMRAVLMLPQYLEVSLSVLYIFLMYENDLGNILTHRFLGAPQPGIQIYLFCSEVVHIEFNKLQPHSEILMHVDSDPPFEKHFSKIMVLSPTCTLESPEELLKNRDTWVLKTLTLNSNSLDTAWKLGILKGLQVILKSIRSNAILLAIPAISSLQLCRKHENEDNAKASPISKPGYNEPKPVPTPQSSARHYFTMEFWILICPAAMDSTGDSYQDEKSSELSACHSIIYNQKPAQERRLLWEQNETPLKTGLKGWVLQRRSDHEDSPLMNEVKEWINELMGYHKKGNWWLHNKMRDLTSNICLLSLIAMDAMSCATSGLCRESPPARRLSPDIAPRPWISQPPERLYRLILKPPTLQFLQFSSTYLIMHHKRKQKFSLIVKPLQQNQANDRKPHDQQTESHSLMLNEMTDILSLCRSLNTDHRILRSDIVCLLSDSVVLYFPRFSCESQVQSHTISFLKFIMTSKWSLGKRTSSSTVYCNCNTVMSEEGNMFNVKSLQNDDAEEKNIKQKKHKYKNGERDVIKRQLEGRLHAAICFSAVFSIVGQILLFVTSTFAFSHLQRGKQSAFESLVKHHLEAAAKA

SEQ ID NO: 764768 - protein, 310 aa, Homo sapiens
VCTGSTMSLTVVSMACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHVLIGTSVVKIPFTILLFFLLHRWCSDKKNAAVMDQEPAGNRTVNSEDSDEQDHQEVSYA

SEQ ID NO: 764769 - protein, 312 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKGFTPSFLRLGSWNVVMFVTYEQLKRALMKVQMLRESPF

SEQ ID NO: 764770 - protein, 210 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNNFPCHFVSAFGAGFCATVVASPVDVVKTRYMNSPPGQYFSPLDCMIKMVAQEGPTAFYKGFTPSFLRLGSWNVVMFVTYEQLKRALMKVQMLRESPF

SEQ ID NO: 764771 - protein, 312 aa, Homo sapiens; identical to SEQ ID NO: 764769

SEQ ID NO: 764772 - protein, 275 aa, Homo sapiens
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKG

SEQ ID NO: 764773 - protein, 696 aa, Homo sapiens
MQLISEYFGFLTKKEPKQEQHLFKVKECFLTKNIVIAYFRIAIMLLKRTMRVINVNYQRLESAGKEKDKKSLQNYTHQKKTITVRNLRVMLSRYFFFFFLTFHIFFFYFLYFILCFGWGCRYMRVYLSEHKYVFSYKVMMMMMMITGSLSLLLRLEFRGAVIAHRSLKLLGWSDSSCLSLLSSWDHRCVTPNLVDFYIFCRDEVSLCFPGWSQTPGFKGFSCRGFPKYWDYRHEPPCPAYTEYYFVSIILKRLNSFMFLVGEQVAECYKREYPRISDQRNPFVVNDIYGEILRLRSVVMLRMGRRTLEVAGIPVDKAFGWKESLAHSCICKNQGAEAHRKLERQDEKVGRDQIIQASSRPCLFNLMYCDCLSVVNILKAVDFGVKSLATGVKYIHCVNLDKLINVTLVLISKSLKGDDCRQCLKETIGEKKSDYTYKTMKRLAPLLISFMVEFIQHSLMENQGLGQERLFSRSYNGASKSRAVKLVLLLLTTFGIMSPGAPLTSVLMQAKCYYCLFKFLRAEPWLFLLVLTQHHTLTQDFFLFFFSLRQSLTLLSRLECSGVFSAHCNLCLPGSSDSPASASQVAGITSTHHQAQLIFVFLVEVGFHHVGQAGLELVASGDLPTSASQSAGITGMSHRSQPALLKKRWLVNPRGMSDEITKATVNHSLFFPEGRSHFYSSADFMYIEKLKHTLKDV

SEQ ID NO: 764774 - protein, 103 aa, Homo sapiens [sequence omitted]

SEQ ID NO: 764775 - protein, 103 aa, Homo sapiens [sequence omitted]

SEQ ID NO: 764776 - protein, 291 aa, Homo sapiens
MRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRMPNSSSYWPSEPMMKQPHLLPEKLLQPQLQPQALHYALANVQQVQIHQNRRRRTGASSTYPLHLA

SEQ ID NO: 764777 - protein, 265 aa, Homo sapiens
RCPGWHDCSQPWALETLAERGVPPRSRPLVGGIQVSTFPQGRTCWGRGDSGSLPLVQLQGQKRLFGKLLSFQAGEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRMPNSSSYWPSEPMMKQPHLLPEKLLQPQLQPQALHYALANVQQVQIHQNRRRRTGASSTYPLHLA

SEQ ID NO: 764778 - protein, 175 aa, Homo sapiens
MRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRMPNSSSYWPSEPMMKQPHLLPEKLLQPQLQPQALHYALANVQQVQIHQNRRRRTGASSTYPLHLA

SEQ ID NO: 764779 - protein, 138 aa, Homo sapiens
FLSAEEYQQKIIPVVVKMFSSTDRAMRIRLLQQMEQFIQYLDEPTVNTQIFPHVVHGFLDTNPAIREQTVKSMLLLAPKLNRGHNLYSMNDCAQKILPVLCGLTVDPEKSVRDQAFKAIRSFLSKLESVSEDPTQLEE

SEQ ID NO: 764780 - protein, 1023 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKK

SEQ ID NO: 764781 - protein, 1060 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQKKFADFCPRGDDKKGFWTCSFFQACLGGCGRQTKFQKAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKK

SEQ ID NO: 764782 - protein, 867 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLVSWALFQGK

SEQ ID NO: 764783 - protein, 36 aa, Homo sapiens
MRGAPSKHLQRVSAQGAQDPMGKGEHGNVGRYQGTC

SEQ ID NO: 764784 - protein, 1023 aa, Homo sapiens; identical to SEQ ID NO: 764780

SEQ ID NO: 764785 - protein, 993 aa, Homo sapiens
EFSDPSLATKRAREDSGMVPLIIPVSVPVRPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKK

SEQ ID NO: 764786 - protein, 917 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKVTPFPTSAA

SEQ ID NO: 764787 - protein, 74 aa, Homo sapiens
HVIPHEAEVAVSRDSATVLQPGQQSETPSQKTKKFQVQYKEIPSQFESKLPIYPMTAPPPPILQWVFPMNNDIL

SEQ ID NO: 764788 - protein, 50 aa, Homo sapiens
MTANGSSRMTTRAANIWFSVVSPSPPQASLSNAGSSQMKWSSRRGAHSGR

SEQ ID NO: 764789 - protein, 76 aa, Homo sapiens
EKLLEGEQSLCNLEDIHMSLEKDVTAMTNSLFIDRQKCMAHRTCYPTILQLAGYQLSSGTVLPPNPPNKQCISFLH

SEQ ID NO: 764790 - protein, 168 aa, Homo sapiens
PRRLRAGGKQTRTHRSSSSSSRSSSSSLRSPSRDMDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 764791 - protein, 78 aa, Homo sapiens
PQAEGRWEANPDASQQQQQQQKQQQQPPQSIRGHRKMVLYTLRAPRSPKMVQGSGCFGRKMDRISSSSGLGCKVLRRH

SEQ ID NO: 764792 - protein, 45 aa, Homo sapiens
VLYTLRAPRSPKMVQGSGCFGRKMDRISSSSGLGCKGKHPLPPRP

SEQ ID NO: 764793 - protein, 170 aa, Homo sapiens
PRRLRAGGKQTRTHRSSSSSSRSSSSSLRSPSRDMDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPDVRSALGEMTILPCLVNLGIKSLVTPFIQGFH

SEQ ID NO: 764794 - protein, 205 aa, Homo sapiens
RNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGS

SEQ ID NO: 764795 - protein, 639 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 764796 - protein, 503 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQVRWECSLAWGRMELPLGCGASQRCDNMEQIF

SEQ ID NO: 764797 - protein, 521 aa, Homo sapiens
HVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 764798 - protein, 521 aa, Homo sapiens; identical to SEQ ID NO: 764797

SEQ ID NO: 764799 - protein, 521 aa, Homo sapiens; identical to SEQ ID NO: 764797

SEQ ID NO: 764800 - protein, 521 aa, Homo sapiens; identical to SEQ ID NO: 764797

SEQ ID NO: 764801 - protein, 83 aa, Homo sapiens
DGQTPGSRKMDSVAFEDVAVNFTQEEWALLDPWQKKLYRDVMLETYRNLASVGDDDNIPSLREQVAHQRYFKTWHVEREYFSK

SEQ ID NO: 764802 - protein, 149 aa, Homo sapiens
MTVNVEKIVREWNQYKKVKKIISKNHQRRMKVILQSNTLLPVVDAVPDLSGCIRQPGLECEEGSKCHKALEKNEREHGRTQWGIQRKSCGRCPGGTQEGTREPENQGRERPEEGSKEASEGKWQNRKTRREQKNEEEKEATRGCALCVG

SEQ ID NO: 764803 - protein, 1108 aa, Homo sapiens
MFLGLGRFSRLVLWFAAFRKLLGHHGLASAKFLWCLCLLSVMSLPQQVWTLPYKIGVVGPWACDSLFSKALPEVAARLAIERINRDPSFDLSYSFEYVILNEDCQTSRALSSFISHHQMASGFIGPTNPGYCEAASLLGNSWDKGIFSWACVNYELDNKISYPTFSRTLPSPIRVLVTVMKYFQWAHAGVISSDEDIWVHTANRVASALRSHGLPVGVVLTTGQDSQSMRKALQRIHQADRIRIIIMCMHSALIGGETQMHLLECAHDLKMTDGTYVFVPYDALLYSLPYKHTPYQVLRNNPKLREAYDAVLTITVESQEKTFYQAFTEAAARGEIPEKLEFDQVSPLFGTIYNSIYFIAQAMNNAMKENGQAGAASLVQHSRNMQFHGFNQLMRTDSNGNGISEYVILDTNLKEWELHSTYTVDMEMELLRFGGTPIHFPGGRPPRADAKCWFAEGKICHGGIDPAFAMMVCLTLLIALLSINGFAYFIRRRINKIQLIKGPNRILLTLEDVTFINPHFGSKRGSRASVSFQITSEVQSGRSPRLSFSSGSLTPATYENSNIAIYEGDWVWLKKFSLGDFGDLKSIKSRASDVFEMMKDLRHENINPLLGFFYDSGMFAIVTEFCSRGSLEDILTNQDVKLDWMFKSSLLLDLIKGMKYLHHREFVHGRLKSRNCVVDGRFVLKVTDYGFNDILEMLRLSEEESSMEELLWTAPELLRAPRGSRLGSFAGDVYSFAIIMQEVMVRGTPFCMMDLPAQEIINRLKKPPPVYRPVVPPEHAPPECLQLMKQCWAEAAEQRPTFDEIFNQFKTFNKGKKTNIIDSMLRMLEQYSSNLEDLIRERTEELEIEKQKTEKLLTQMLPPSVAESLKKGCTVEPEGFDLVTLYFSDIVGFTTISAMSEPIEVVDLLNDLYTLFDAIIGSHDVYKVETIGDAYMVASGLPKRNGSRHAAEIANMSLDILSSVGTFKMRHMPEVPVRIRIGLHSGPVVAGVVGLTMPRYCLFGDTVNTASRMESTGLPYRIHVSLSTVTILQNLSEGYEVELRGRTELKGKGTEETFWLIGKKGFMKPLPVPPPVDKDGQVGHGLQPVEIAAFQRRKAERQLVRNKP

SEQ ID NO: 764804 - protein, 179 aa, Homo sapiens
MARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLTDGKLRFVVEPVEASFPQLLVYERLQQLELWKIIAEPVT

SEQ ID NO: 764805 - protein, 111 aa, Homo sapiens
CLLLFHRDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKR

SEQ ID NO: 764806 - protein, 114 aa, Homo sapiens
DRRSVKARPGDMRSVRDRKARWVETAKPFPLMMAVCASGWLVCRLNFTLRHLDVTCEAYDHFRSCLHALEQLTDGKLRFVVEPVEASFPQLLVYERLQQLVGPGPEAGPLVALL

SEQ ID NO: 764807 - protein, 179 aa, Homo sapiens; identical to SEQ ID NO: 764804

SEQ ID NO: 764808 - protein, 348 aa, Homo sapiens [sequence omitted]

SEQ ID NO: 764809 - protein, 205 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIGVAGRPAPGRLHPVPTGPLPRMYSAGARGRHGAR

SEQ ID NO: 764810 - protein, 199 aa, Homo sapiens [sequence omitted]

SEQ ID NO: 764811 - protein, 199 aa, Homo sapiens [sequence omitted]

SEQ ID NO: 764812 - protein, 179 aa, Homo sapiens; identical to SEQ ID NO: 764804

SEQ ID NO: 764813 - protein, 260 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIGGIVRVKELDWLKDDLCTDPKVPFSWSQEEISDLYDHTTILFAAEVFYDDDLTDAVFKTLSRLAHRLKNACTAILSVEKRSSGRSSQNQ

SEQ ID NO: 764814 - protein, 173 aa, Homo sapiens [sequence omitted]

SEQ ID NO: 764815 - protein, 140 aa, Homo sapiens
MGTKCAFVLSSDPKVPFSWSQEEISDLYDHTTILFAAEVFYDDDLTDAVFKTLSRLAHRLKNACTAILSVEKRLNFTLRHLDVTCEAYDHFRSCLHALEQLTDGKLRFVVEPVEASFPQLLVYERLQQLELWKIIAEPVT

SEQ ID NO: 764816 - protein, 160 aa, Homo sapiens
MSCEEVVLCPFYPKVPFSWSQEEISDLYDHTTILFAAEVFYDDDLTDAVFKTLSRLAHRLKNACTAILSVEKRLNFTLRHLDVTCEAYDHFRSCLHALEQLTDGKLRFVVEPVEASFPQLLVYERLQQLPLCHSKTEQPRATKKGGSRSSAPAPARLLRG

SEQ ID NO: 764817 - protein, 264 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIEHTMAPPWRMLAAGVAGACPGTTPVRQTLEVSALDSGPRSCYRAQGGRCPVGRSGRAGIAHPVRGFAPRGGRPPGGARAAWPPRGDRFCCDVL

SEQ ID NO: 764818 - protein, 111 aa, Homo sapiens
DRRSVKARPGDMRSVRDRKARWVETAKPFPLMMAVCASGWLVCRLNFTLRHLDVTCEAYDHFRSCLHALEQLTDGKLRFVVEPVEASFPQLLVYERLQQLELWKIIAEPVT

SEQ ID NO: 764819 - protein, 433 aa, Homo sapiens
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIEHTMATPLEDVGKQVGRSCPLPVALMGPCRASRCLSLLSSSLQVWRGALLLADYILFRQDLFRGCTALELGAGTGLASIIAATMARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLTDGKLRFVVEPVEASFPQLLVYERLQQLELWKIIAEPVT

SEQ ID NO: 764820 - protein, 179 aa, Homo sapiens; identical to SEQ ID NO: 764804

SEQ ID NO: 764821 - protein, 182 aa, Homo sapiens [sequence omitted]

SEQ ID NO: 764822 - protein, 199 aa, Homo sapiens [sequence omitted]

SEQ ID NO: 764823 - protein, 179 aa, Homo sapiens; identical to SEQ ID NO: 764804

SEQ ID NO: 764824 - protein, 205 aa, Homo sapiens; identical to SEQ ID NO: 764809

SEQ ID NO: 764825 - protein, 140 aa, Homo sapiens
MSCEEVVLCPFYPKVPFSWSQEEISDLYDHTTILFAAEVFYDDDLTDAVFKTLSRLAHRLKNACTAILSVEKRLNFTLRHLDVTCEAYDHFRSCLHALEQLTDGKLRFVVEPVEASFPQLLVYERLQQLELWKIIAEPVT

SEQ ID NO: 764826 - protein, 1557 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGENSTEAKAVDSNNQSKSPLEKFMVKLCTHHQKQFIRVLNDLYTESQPGTEDLQPSDSGAMDVSTCNAGCAQLSTKHKEKDALCLDMKSSASVDLFVDSSDSHSPLHLTEQTPKKPPPEINPVDGRENALTVVQKDSSELPTTKSNSINSSSVDSFTPGYLTASNCSSVNFHHIPKILEGQTTGQEQDTNVNICEDGKDHMQSSALVESLITVKMAAENSEEGNTCIIPQRNLFKALSEEAWNSGFMGNSSRTADKENTLQCPKTPLRQDLEANEQDARPKQENHLHSLGRNKVGYHLHPSDKGQFDHSKDGWLGPGPMPAVHKAANGHSRTKMISTSIKTARKSKRASGLRINDYDNQCDVVYISQPITECHFENQKSILSSRKTARKSTRGYFFNGDCCELPTVRTLARNLHSQEKASCSALASEAVFTPKQTLTIPAPRHTVDVQLPREDNPEEPSKEITSHEEGGGDVSPRKEPQEPEVCPTKIKPNLSSSPRSEETTASSLVWPLPAHLPEEDLPEGGSTVSAPTASGMSSPEHNQPPVALLDTEEMSVPQDCHLLPSTESFSGGVSEDVISRPHSPPEIVSREESPQCSENQSSPMGLEPPMSLGKAEDNQSISAEVESGDTQELNVDPLLKESSTFTDENPSETEESEAAGGIGKLEGEDGDVKCLSEKDTYDTSIDSLEENLDKKKKGKKFPEASDRCLRSQLSDSSSADRCLRNQSSDSSSACLEIKVPKNPSAKRSKKEGHPGGTTPKGLLPDSFHTETLEDTEKPSVNERPSEKDAEQEGEGGGIITRQTLKNMLDKEVKELRGEIFPSRDPITTAGQPLPGERLEIYVQSKMDEKNAHIPSESIACKRDPEQAKEEPGHIPTQHVEEAVNEVDNENTQQKDDESDAPCSSLGLSSSGSGDAARAPKSVPRPKRLTSSTYNLRHAHSLGSLDASKVTSEKEAAQVNPIMPKENGASESGDPLDEDDVDTVVDEQPKFMEWCAEEENQELIANFNAQYMKVQKGWIQLEKEGQPTPRARNKSDKLKEIWKSKKRSRKCRSSLESQKCSPVQMLFMTNFKLSNVCKWFLETTETRSLVIVKKLNTRLPGDVPPVKHPLQKYAPSSLYPSSLQAERLKKHLKKFPGATPAKNNWKMQKLWAKFRENPDQVEPEDGSDVSPGPNSEDSIEEVKEDRNSHPPANLPTPASTRILRKYSNIRGKLRAQQRLIKNEKMECPDALAVESKPSRKSVCINPLMSPKLALQVDADGFPVKPKSTEGMKGRKGKQVSEILPKAEVQSKRKRTEGSSPPDSKNKGPTVKASKEKHADGATKTPAAKRPAARDRSSQPPKKTSLKENKVKIPKKSAGKSCPPSRKEKENTNKRPSQSIASETLTKPAKQKGAGESSSRPQKATNRKQSSGKTRARPSTKTPESSAAQRKRKLKAKLDCSHSKRRRLDAK

SEQ ID NO: 764827 - protein, 1557 aa, Homo sapiens; identical to SEQ ID NO: 764826

SEQ ID NO: 764828 - protein, 112 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGG

SEQ ID NO: 764829 - protein, 433 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMRSEGPDVSVKIELDPQGEAAQSANESKNE

SEQ ID NO: 764830 - protein, 1511 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGENSTEAKAVDSNNQSKSPLEKFMVKLCTHHQKQFIRVLNDLYTESQPGTEDLQPSDSGAMDVSTCNAGCAQLSTKHKEKDALCLDMKSSASVDLFVDSSDSHSPLHLTEQTPKKPPPEINPVDGRENALTVVQKDSSELPTTKSNSINSSSVDSFTPGYLTASNCSSVNFHHIPKILEGQTTGQEQDTNVNICEDGKDHMQSSALVESLITVKMAAENSEEGNTCIIPQRNLFKALSEEAWNSGFMGNSSRTADKENTLQCPKTPLRQDLEANEQDARPKQENHLHSLGRNKVGYHLHPSDKGQFDHSKDGWLGPGPMPAVHKAANGHSRTKMISTSIKTARKSKRASGLRINDYDNQCDVVYISQPITECHFENQKSILSSRKTARKSTRGYFFNGDCCELPTVRTLARNLHSQEKASCSALASEAVFTPKQTLTIPAPRHTVDVQLPREDNPEEPSKEITSHEEGGGDVSPRKEPQEPEVCPTKIKPNLSSSPRSEETTASSLVWPLPAHLPEEDLPEGGSTVSAPTASGMSSPEIVSREESPQCSENQSSPMGLEPPMSLGKAEDNQSISAEVESGDTQELNVDPLLKESSTFTDENPSETEESEAAGGIGKLEGEDGDVKCLSEKDTYDTSIDSLEENLDKKKKGKKFPEASDRCLRSQLSDSSSADRCLRNQSSDSSSACLEIKVPKNPSAKRSKKEGHPGGTTPKGLLPDSFHTETLEDTEKPSVNERPSEKDAEQEGEGGGIITRQTLKNMLDKEVKELRGEIFPSRDPITTAGQPLPGERLEIYVQSKMDEKNAHIPSESIACKRDPEQAKEEPGHIPTQHVEEAVNEVDNENTQQKDDESDAPCSSLGLSSSGSGDAARAPKSVPRPKRLTSSTYNLRHAHSLGSLDASKVTSEKEAAQVNPIMPKENGASESGDPLDEDDVDTVVDEQPKFMEWCAEEENQELIANFNAQYMKVQKGWIQLEKEGQPTPRARNKSDKLKEIWKSKKRSRKCRSSLESQKCSPVQMLFMTNFKLSNVCKWFLETTETRSLVIVKKLNTRLPGDVPPVKHPLQKYAPSSLYPSSLQAERLKKHLKKFPGATPAKNNWKMQKLWAKFRENPDQVEPEDGSDVSPGPNSEDSIEEVKEDRNSHPPANLPTPASTRILRKYSNIRGKLRAQQRLIKNEKMECPDALAVESKPSRKSVCINPLMSPKLALQVDADGFPVKPKSTEGMKGRKGKQVSEILPKAEVQSKRKRTEGSSPPDSKNKGPTVKASKEKHADGATKTPAAKRPAARDRSSQPPKKTSLKENKVKIPKKSAGKSCPPSRKEKENTNKRPSQSIASETLTKPAKQKGAGESSSRPQKATNRKQSSGKTRARPSTKTPESSAAQRKRKLKAKLDCSHSKRRRLDAK

SEQ ID NO: 764831 - protein, 83 aa, Homo sapiens
GAQRGDVTGLEGQNPELRLGAPPPPLSLASEAAQIQQDQGQWRQDFTQGRDQDGLVLQCPGTPWATEGSTLRTGLLSERLLVT

SEQ ID NO: 764832 - protein, 133 aa, Homo sapiens
MRGCHMGPWLGLLPETSPCGFSLWAGLLHSVSLGCTGEHLKSERGRHRSQVHHFDHILFIHLPGSREGEKSSTCKWGSTRGTRNIAASSMGKCFCNTVESCQYYLHFAINLPRFREFSTCLDWQFSTFSFSQI

SEQ ID NO: 764833 - protein, 107 aa, Homo sapiens [sequence omitted]

SEQ ID NO: 764834 - protein, 107 aa, Homo sapiens [sequence omitted]

SEQ ID NO: 764835 - protein, 75 aa, Homo sapiens
NLGFIKNIQQVFGDKKKFWLIPIGSSPGDGHSFPMRSMNESQNPLLANEETWEDNEDDNQDYPEGSSSLAVETET

SEQ ID NO: 764836 - protein, 485 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764837 - protein, 485 aa, Homo sapiens; identical to SEQ ID NO: 764836

SEQ ID NO: 764838 - protein, 446 aa, Homo sapiens
NQSESSRPLQLSAVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764839 - protein, 517 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGTEERNNMCRINCNYEYFWQVLWDQNSQVIRSSSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764840 - protein, 337 aa, Homo sapiens
RLGPPVACAPARGAEGTGSDSEMAASMFYGRLVAVATLRNHRPRTAQRAAAQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764841 - protein, 463 aa, Homo sapiens
APWAACRLCACARRRGDGVRLRNGGLHVLRQASGRGHPSEPPASDGPAGCCSGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLGTMCFYVRIGFTKFNLDLLSLIYFLCVCCLYNIIFPYIVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764842 - protein, 213 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQVSNCRHDTYGINL

SEQ ID NO: 764843 - protein, 463 aa, Homo sapiens
APWAACRLCACARRRGDGVRLRNGGLHVLRQASGRGHPSEPPASDGPQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764844 - protein, 523 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLGTMCFYVRIGFTKFNLDLLSLIYFLCVCCLYNIIFPYIVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764845 - protein, 467 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 764846 - protein, 473 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVFWDSVLEAVCL

SEQ ID NO: 764847 - protein, 381 aa, Homo sapiens
RLGPPVACAPARGAEGTGSDSEMAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAETPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQYKH

SEQ ID NO: 764848 - protein, 1366 aa, Homo sapiens
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764849 - protein, 1312 aa, Homo sapiens
AAVMREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764850 - protein, 504 aa, Homo sapiens
THAVADGVGRPTRPGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764851 - protein, 423 aa, Homo sapiens
GLVANSARGRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764852 - protein, 1312 aa, Homo sapiens; identical to SEQ ID NO: 764849

SEQ ID NO: 764853 - protein, 1064 aa, Homo sapiens
AAVMREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDKKNIILEEGKEILVGDVGQTVDDPYATFVKMLPDKDCRYALYDATYETKESKKEDLVFIFWAPESA

SEQ ID NO: 764854 - protein, 560 aa, Homo sapiens
AAVMREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKVSGCGLREAVANAKHPFFPLKQVKKAGPGSCKNWFPAVTFPTAVLG

SEQ ID NO: 764855 - protein, 295 aa, Homo sapiens
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQVSWAQPRAPSPALLMGPKERAQHRHLHCGERLAGLEAGSAHFIAEEMEALGEHLAAGADRAVSHPWVTQLPMVSLAPAPGGAQCPRRWMQSAALDAVSGVGCSQRRWMQSAALDAVSGVGC

SEQ ID NO: 764856 - protein, 38 aa, Homo sapiens
MDRDYPQHEPPPAGSLLYSPPPLQKRMLTAYWKLSVRI

SEQ ID NO: 764857 - protein, 1339 aa, Homo sapiens
AAVMREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVGSGGVTPPEEGPRGADRARPQRPPPQVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764858 - protein, 487 aa, Homo sapiens
GVQGKPASSLGLLPESPSPPEYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764859 - protein, 275 aa, Homo sapiens
GRRAQLSLGLPALTPPRLMRPCVPEVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 764860 - protein, 674 aa, Homo sapiens
AAVMREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPRPRSWQGGACGFYVFIASSDVHM

SEQ ID NO: 764861 - protein, 886 aa, Homo sapiens
MRGFNLLLFWGCCVMHSWEGHIRPTRKPNTKGNNCRDSTLCPAYATCTNTVDSYYCTCKQGFLSSNGQNHFKDPGVRCKDIDECSQSPQPCGPNSSCKNLSGRYKCSCLDGFSSPTGNDWVPGKPGNFSCTDINECLTSRVCPEHSDCVNSMGSYSCSCQVGFISRNSTCEDVNECADPRACPEHATCNNTVGNYSCFCNPGFESSSGHLSFQGLKASCEDIDECTEMCPINSTCTNTPGSYFCTCHPGFAPSSGQLNFTDQGVECRDIDECRQDPSTCGPNSICTNALGSYSCGCIVGFHPNPEGSQKDGNFSCQRVLFKCKEDVIPDNKQIQQCQEGTAVKPAYVSFCAQINNIFSVLDKVCENKTTVVSLKNTTESFVPVLKQISMWTKFTKEETSSLATVFLESVESMTLASFWKPSANVTPAVRAEYLDIESKVINKECSEENVTLDLVAKGDKMKIGCSTIEESESTETTGVAFVSFVGMESVLNERFFQDHQAPLTTSEIKLKMNSRVVGGIMTGEKKDGFSDPIIYTLENVQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKTGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 764862 - protein, 886 aa, Homo sapiens; identical to SEQ ID NO: 764861

SEQ ID NO: 764863 - protein, 148 aa, Homo sapiens
DGEPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPPK

SEQ ID NO: 764864 - protein, 157 aa, Homo sapiens
MAELTALESLIEMGFPRGRGGEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPPK

SEQ ID NO: 764865 - protein, 77 aa, Homo sapiens
LSVRCGQPAQRAMELMTSEQNRRLGAAGYEAPGVTPPLDGAAGARAGKLVPGGVAGLMTQAAADHPGIRSRGRFLGS

SEQ ID NO: 764866 - protein, 390 aa, Homo sapiens
NEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESIQQHSLDAVLARSDSAQIVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQLTAHSSVARHLLRDLPGVAATEETG

SEQ ID NO: 764867 - protein, 317 aa, Homo sapiens
NEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESIQQHSLDAVLARSDSAQIVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHK

SEQ ID NO: 764868 - protein, 1068 aa, Homo sapiens [sequence omitted]

SEQ ID NO: 764869 - protein, 204 aa, Homo sapiens
MKSYRNQPQANSHVYRSVLLKSIPREVVAYNKNINDDFEMIDCDLEDATKTPDCSSGPVKEERSDLIKFYNTIYVGRVKSFALKYDLANQDHMMDAPPLSPFPHIKQQPGSPRRISQQHSIYISPHKNGSGLTPRSALLYKFNGSPSKSLKDINNMIRQGEQRTKKRVIAIDSDAESPAKRVCQENDDVLLKRLQDVVSERANH

SEQ ID NO: 764870 - protein, 917 aa, Homo sapiens
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCGKLSNLTYYM

SEQ ID NO: 764871 - protein, 323 aa, Homo sapiens
EFPRLVSRGLSLRAGVQMGVQPPRFPATPGRSARAVGARSCGRASPATRSPPETPPATPFQRANSRATCPGWGGTYANSVAFGRHIVIQELEGGSGADLGEHSCRPASQPRFPRPAEARSHPATRRPASGPAMGKTNSKLAPEVLEDLVQNTEFSEQELKQWYKGFLKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 764872 - protein, 323 aa, Homo sapiens; identical to SEQ ID NO: 764871

SEQ ID NO: 764873 - protein, 323 aa, Homo sapiens; identical to SEQ ID NO: 764871

SEQ ID NO: 764874 - protein, 323 aa, Homo sapiens; identical to SEQ ID NO: 764871

SEQ ID NO: 764875 - protein, 323 aa, Homo sapiens; identical to SEQ ID NO: 764871

SEQ ID NO: 764876 - protein, 146 aa, Homo sapiens
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 764877 - protein, 179 aa, Homo sapiens
IKLIFSYEIMRRSSSMLLLSTATENRRSRGGEGAEFQVSQICSDTKQRIRMGRSVMASPVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 764878 - protein, 146 aa, Homo sapiens; identical to SEQ ID NO: 764876

SEQ ID NO: 764879 - protein, 178 aa, Homo sapiens
MSVLLGPCHTGVPTPRLAEGGLNDHRLRISERQLEMTLRNRWAITAALATWLYILLAPSRPTVAFPPVDGGPRDRARTEDSSPLHSCLWQIHQLGGPPFLPPASVRVRALHVDSHRFLLQQPLPLNRTGIKPQQLVHPTQSTVKAAAQTSPRLSQGLYSFRLSGSQLAEVKMAWAPLL

SEQ ID NO: 764880 - protein, 155 aa, Homo sapiens
GKGYKYNPMYSAYNNVKACLRNHQGPLPPVPLHLRNAPTVAFPPVDGGPRDRARTEDSSPLHSCLWQIHQLGGPPFLPPASVRVRALHVDSHRFLLQQPLPLNRTGIKPQQLVHPTQSTVKAAAQTSPRLSQGLYSFRLSGSQLAEVKMAWAPLL

SEQ ID NO: 764881 - protein, 69 aa, Homo sapiens
LFYWRRKWGTEKFSYWSEVTQRVSREGRGSWNLNLAVWLPSGEEQWMRAKPTRAQTHLRCAAFEPHKSK

SEQ ID NO: 764882 - protein, 69 aa, Homo sapiens; identical to SEQ ID NO: 764881

SEQ ID NO: 764883 - protein, 72 aa, Homo sapiens
SSSVPTGYSITTSTSARRLSRYNDQASSSRIIERIFSGAVTRGKTIQKEGRMSYADFVWFLISEEDKRNPTS

SEQ ID NO: 764884 - protein, 529 aa, Homo sapiens
MMIKETSLRRDPDLRGELAFLARGCDFVLPSRFKKRLKSFQQTQIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 764885 - protein, 233 aa, Homo sapiens
IAATTLLTSTATASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 764886 - protein, 881 aa, Homo sapiens
MAATYRLVVSTVNHYSSVVIDRRFEQAIHYCTGTCHTFTHGIDCIVVHHSVCADLLHIPVSQFKDADLNSMFLPHENGLSSAEGDYPQQAFTGIPRVKRGSTFQNTYNLKDIAGEAISFASGKIKEFSFEKLKNSNHAAYRKGRKVKSDSFNRRSVDLDLLCGHYNNDGNAPSFGLLRSSSVEEKPLSHRNSLDTNLTSMFLQNFSEEDLVTQILEKHKIDNFSSGTDIKMCLDILLKCSEDLKKCTDIIKQCIKKKSGSSISEGSGNDTISSSETVYMNVMTRLASYLKKLPFEFMQSGNNEALDLTELISNMPSLQLTPFSPVFGTEQPPKYEDVVQLSASDSGRFQTIELQNDKPNSRKMDTVQSIPNNSTNSLYNLEVNDPRTLKAVQVQSQSLTMNPLENVSSDDLMETLYIEEESDGKKALDKGQKTENGPSHELLKVNEHRAEFPEHATHLKKCPTPMQNEIGKIFEKSFVNLPKEDCKSKVSKFEEGDQRDFTNSSSQEEIDKLLMDLESFSQKMETSLREPLAKGKNSNFLNSHSQLTGQTLVDLEPKSKVSSPIEKVSPSCLTRIIETNGHKIEEEDRALLLRILESIEDFAQELVECKSSRGSLSQEKEMMQILQETLTTSSQANLSVCRSPVGDKAKDTTSAVLIQQTPEVIKIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQKRRI

SEQ ID NO: 764887 - protein, 196 aa, Homo sapiens
MAATYRLVVSTVNHYSSVVIDRRFEQAIHYCTGTCHTFTHGIDCIVVHHSVCADLLHIPVSQFKDADLNSMFLPHENGLSSAEGDYPQQAFTGIPRVKRGSTFQNTYNLKDIAGEAISFASGKIKEFSFEKLKNSNHAAYRKGRKVKSDSFNRRSVDLDLLCGHYNNDGNAPSFGLLRSSSVEKNLCLIETHWIRT

SEQ ID NO: 764888 - protein, 1150 aa, Homo sapiens
MAATYRLVVSTVNHYSSVVIDRRFEQAIHYCTGTCHTFTHGIDCIVVHHSVCADLLHIPVSQFKDADLNSMFLPHENGLSSAEGDYPQQAFTGIPRVKRGSTFQNTYNLKDIAGEAISFASGKIKEFSFEKLKNSNHAAYRKGRKVKSDSFNRRSVDLDLLCGHYNNDGNAPSFGLLRSSSVEEKPLSHRNSLDTNLTSMFLQNFSEEDLVTQILEKHKIDNFSSGTDIKMCLDILLKCSEDLKKCTDIIKQCIKKKSGSSISEGSGNDTISSSETVYMNVMTRLASYLKKLPFEFMQSGNNEALDLTELISNMPSLQLTPFSPVFGTEQPPKYEDVVQLSASDSGRFQTIELQNDKPNSRKMDTVQSIPNNSTNSLYNLEVNDPRTLKAVQVQSQSLTMNPLENVSSDDLMETLYIEEESDGKKALDKGQKTENGPSHELLKVNEHRAEFPEHATHLKKCPTPMQNEIGKIFEKSFVNLPKEDCKSKVSKFEEGDQRDFTNSSSQEEIDKLLMDLESFSQKMETSLREPLAKGKNSNFLNSHSQLTGQTLVDLEPKSKVSSPIEKVSPSCLTRIIETNGHKIEEEDRALLLRILESIEDFAQELVECKSSRGSLSQEKEMMQILQETLTTSSQANLSVCRSPVGDKAKDTTSAVLIQQTPEVIKIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 764889 - protein, 414 aa, Homo sapiens
MDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 764890 - protein, 1150 aa, Homo sapiens; identical to SEQ ID NO: 764888

SEQ ID NO: 764891 - protein, 214 aa, Homo sapiens
KCPTPMQNEIGKIFEKSFVNLPKEDCKSKVSKFEEGDQRDFTNSSSQEEIDKLLMDLESFSQKMETSLREPLAKGKNSNFLNSHSQLTGQTLVDLEPKSKVSSPIEKVSPSCLTRIIETNGHKIEEEDRALLLRILESIEDFAQELVECKSSRGSLSQEKEMMQILQETLTTSSQANLSVCRSPVGDKAKDTTSAVLIQQTPEVIKVRPNNFES

SEQ ID NO: 764892 - protein, 744 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764893 - protein, 159 aa, Homo sapiens
ISEKLCSQRKRRGIWCSRVNELQEVGPGFIEAILPFSDGGGICMSRVDELICQVIDRVHALLPNVPGVSGKAPGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764894 - protein, 108 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYDVGIIYESWQERDPLETCS

SEQ ID NO: 764895 - protein, 744 aa, Homo sapiens; identical to SEQ ID NO: 764892

SEQ ID NO: 764896 - protein, 418 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEIRCVAPDPWEGPGVCVATPLGWGLLEVTQWVFRTCLGGDLQKATVPPLG

SEQ ID NO: 764897 - protein, 688 aa, Homo sapiens
SGTLHKNINMSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764898 - protein, 744 aa, Homo sapiens; identical to SEQ ID NO: 764892

SEQ ID NO: 764899 - protein, 744 aa, Homo sapiens; identical to SEQ ID NO: 764892

SEQ ID NO: 764900 - protein, 745 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLEWAAHRSPVVHCL

SEQ ID NO: 764901 - protein, 446 aa, Homo sapiens
MGISGQEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764902 - protein, 386 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVHCLTRLWTRRPSTLLFLGMGIKAADSPRQAVAPEASSAAGFAGAGRACVLASPTLRGCLSSSLLCSRCVPILMILSGAFCTA

SEQ ID NO: 764903 - protein, 249 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMYSASVSVEGQTWDKGKLKGMTHPTGLHPGCGTSMCPGIRKALCLKSGFCSYLSPVSHLISPARRELLKAGCVSSSRKSCAHISRLCTKGNAAFTPPRAESLTHITGSPGAHSMSTCCHTVPMS

SEQ ID NO: 764904 - protein, 103 aa, Homo sapiens
MPNRTAKRFEEQGHLAVVLVAAPSAAAISPAAAPQAVGHPAASPAAVSPAAASPAAVSPAAVPQAVGHPAASPVAAIPAAPSLAAVSPCAASVRSEALDSGLM

SEQ ID NO: 764905 - protein, 80 aa, Homo sapiens
PFQTQHSTHKGLHRDCCAGVCAVPCIASPCGGLCVSVLVSVRSLHSRPYGGLCMSCAVPCIAGPYGGLCVRCAGVCAVPA

SEQ ID NO: 764906 - protein, 1076 aa, Homo sapiens
AGGRGRATRKVRRPSRLPRWDPGLAVPRWPPAQATAARMGRKVTVATCALNQWALDFEGNLQRILKSIEIAKNRGARYRLGPELEICGYGCWDHYYESDTLLHSFQVLAALLESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEIRCVAPDPWEGPGVCVATPLGWGLLEVTQWVFRTCLGGDLQKATVPPLGVRAWMLEPEPLGVTPSLLLPRAVTLGPKVLSVHSVVQCPHFKMRTMIIPTSWGCLQNHMCPFSRGAYSRDGRPESPALTLALQPPGACLGGLLGAVGRGHRLRAPCSELPCSLGPACWLWDFLRRSQQVRLPVSSEPTLLVLLVGLVLFWGRVGIFFFFFSANNKKHFIISASMGSLVCASQRQGGHSGWWVSSTFGGSAEPSPSAFRVTLTIIASIVIMRICSSSVESASDTPRSEVSFFPLKNPFILPRAGICPDPMESATPTCISVDASLRSMGGAWLIHGHAASPRLCSRCLIGPFQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764907 - protein, 705 aa, Homo sapiens
AGGRGRATRKVRRPSRLPRWDPGLAVPRWPPAQATAARMGRKVTVATCALNQWALDFEGNLQRILKSIEIAKNRGARYRLGPELEIWPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHHVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764908 - protein, 744 aa, Homo sapiens; identical to SEQ ID NO: 764892

SEQ ID NO: 764909 - protein, 744 aa, Homo sapiens; identical to SEQ ID NO: 764892

SEQ ID NO: 764910 - protein, 335 aa, Homo sapiens
MCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764911 - protein, 439 aa, Homo sapiens
MRICSSSVESASDTPRSEVSFFPLKNPFILPRAGICPDPMESATPTCISVDASLRSMGGAWLIHGHAASPRLCSRCLIGPFQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764912 - protein, 160 aa, Homo sapiens
QLGTIRRVWSSASASCLQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 764913 - protein, 72 aa, Homo sapiens
TGRPAVRRPLSPLPRLKPLSPLALAVPGLSQNSPAKPSRGPRALGTGWGRPPCESWLFAEQHVLCLPKSRLL

SEQ ID NO: 764914 - protein, 322 aa, Homo sapiens
MAAPPSPGRTADQADQVCTFLFKKPGRKGAAGLRKRPACDPEHGESSSSGDEGDTVAQPPRVAPRPRGLHSWQKAAHGDRRGEEAAPESLDVVYRSTRSAKPVGPEDMGATADFEQDTEKEHHTPTILKCSQRVQEALRGREHDHIYRGIHSYLRYLKPKDTSMGNSSSGMARKGPIRAPGHLRATVRWDYQPDICKDYKETGFCGFGDSCKFLHDRSDYKLGWEIERELEEGRYCICEDENHEVGSEEEEIPFRCFICRQAFQNPVVTKCRHYFCESCALEHFRATPRCYICDQPTGGIFNPAKELMAKLQKLQAAEGKKR

SEQ ID NO: 764915 - protein, 322 aa, Homo sapiens; identical to SEQ ID NO: 764914

SEQ ID NO: 764916 - protein, 84 aa, Homo sapiens
KTLLSLCSSPGVFAPIENDENRAEKSCLQESSSWRLEEIASKKAMFVSLSCALFQPFWFLPPPSQGPGLTILPHSPGLARRGAP

SEQ ID NO: 764917 - protein, 509 aa, Homo sapiens
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 764918 - protein, 509 aa, Homo sapiens; identical to SEQ ID NO: 764917

SEQ ID NO: 764919 - protein, 509 aa, Homo sapiens; identical to SEQ ID NO: 764917

SEQ ID NO: 764920 - protein, 462 aa, Homo sapiens
MSDAQLGPLRLTLLSVSARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 764921 - protein, 454 aa, Homo sapiens
MSDAQLGPLRLTLLSVSARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVRSL

SEQ ID NO: 764922 - protein, 92 aa, Homo sapiens
PLRPLSCEEDDRMGQPTEFHLLTGWLAQPRWCPALSIQAKPILHHGQVQMLSQPEPEQILPPETKKSQTKEAELPDTEESHEVLPPQVQTEM

SEQ ID NO: 764923 - protein, 92 aa, Homo sapiens; identical to SEQ ID NO: 764922

SEQ ID NO: 764924 - protein, 92 aa, Homo sapiens; identical to SEQ ID NO: 764922

SEQ ID NO: 764925 - protein, 161 aa, Homo sapiens
SRCSSSASFPCPRPPYCPVPSFLFKMASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKLPEPTWLL

SEQ ID NO: 764926 - protein, 457 aa, Homo sapiens
SRCSSSASFPCPRPPYCPVPSFLFKMASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTNVQEAQKILNNSGLPITSAIDLEDAAKKAVASVAKK

SEQ ID NO: 764927 - protein, 457 aa, Homo sapiens; identical to SEQ ID NO: 764926

SEQ ID NO: 764928 - protein, 457 aa, Homo sapiens; identical to SEQ ID NO: 764926

SEQ ID NO: 764929 - protein, 457 aa, Homo sapiens; identical to SEQ ID NO: 764926

SEQ ID NO: 764930 - protein, 233 aa, Homo sapiens
SRCSSSASFPCPRPPYCPVPSFLFKMASPVAAQAGKLLRALALRPRFLAAGSQAVQLTSRRWLNLQEYQSKKLMSDNGVRVQRFFVADTANEALEAAKRLNAKEIVLKAQILAGGRGPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQLSQYD

SEQ ID NO: 764931 - protein, 416 aa, Homo sapiens
MNEQSIGLPVSLAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTNVQEAQKILNNSGLPITSAIDLEDAAKKAVASVAKK

SEQ ID NO: 764932 - protein, 323 aa, Homo sapiens
SRCSSSASFPCPRPPYCPVPSFLFKMASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQVEAILVNIFGGIVNCAIIANGITKACRELELKVPLVVRLEGTNVQEAQKILNNSGLPITSAIDLEDAAKKAVASVAKK

SEQ ID NO: 764933 - protein, 106 aa, Homo sapiens
RTSAHAQRTAHTRHTVITRQLVPSAQSAHTQHTVSAHQHVLSAQSAHSTHSVSARQHVLSAQSAHTAHTCLVHISTCSAHTWHTRLAHYTCSAHGQCTSALCARRG

SEQ ID NO: 764934 - protein, 384 aa, Homo sapiens
MLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 764935 - protein, 426 aa, Homo sapiens
MLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKSQQDGRSNRRQHERLTSGTSGHVWDPGSFFRIRVSGKGARKLGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 764936 - protein, 373 aa, Homo sapiens
MLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 764937 - protein, 134 aa, Homo sapiens
MLGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 764938 - protein, 180 aa, Homo sapiens
MHSDVSVASLDRLVAWPGSVAVAMRAQGLLGQLLPFSLFPANRCCLYHHRDLPVESVGDHRGQLPPAVCPQVPEAQALSSQLLQAGLLRGCAPPAGWPQHLLPFPAPCALASERRVCHCYQASTTRKGGYARRAQGTDAETASPSQCRDVTPARQAQGTDARMASPSQCEASPLPGKPRA

SEQ ID NO: 764939 - protein, 125 aa, Homo sapiens
MIQAADCGIGIEGKVGSPFYQHISTQSAHINTTQHMLGHCTLSTYLVSARQHVLSVRSVSKHSAHAWSTHISTCSAHSQHTLGTRSVGARQHMLSAQHTLGTRSSHVSLCPAHSQHTLSTRSAHI

SEQ ID NO: 764940 - protein, 266 aa, Homo sapiens
MHSDVSVASLDRLVAWPGSVAVAMRAQGLLGQLLPFSLFPANRCCLYHHRDLPVESVGDHRGQLPPAVCPQVPEAQALSSQLLQAGLLRGCAPPAGWPQHLLPFPAPCALASERRVCHCYQASTTRKGGYARRAQGTDAETASPSQCRDVTPARQAQGTEAGTASPSQCEASPMLGKPRAQMPGWPLPLSAGTSPLPGKPRAQMLRWPLPLKCGASPLLFFLFLYCQNCISILKQLEFLLKMSPNYFTITVKGSSYSGILRIRLKV

SEQ ID NO: 764941 - protein, 379 aa, Homo sapiens
ANNALFLCACNLDNILIWDSFSPLMEVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 764942 - protein, 384 aa, Homo sapiens; identical to SEQ ID NO: 764934

SEQ ID NO: 764943 - protein, 351 aa, Homo sapiens
MLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQVCTIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 764944 - protein, 220 aa, Homo sapiens
MLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQLCFSQSSTSHTRPCITGSLIGVGCHTIHPVSRVLLMS

SEQ ID NO: 764945 - protein, 276 aa, Homo sapiens
MLRSAAGPSSNATPTTTKAKRPVPTPSSRPDPQPSGDAASCLLFILQRGPPCSPHEKFCSGVPQRGALLETLKEKARLVDHTRAARARAWTGSTCVLRSLTTALGPALVQGAAVQGRPRGPACSAAALIPSPGLGWVTGRQTQEGPRPRPRRAHKRRGRPNLRPRSIRLQDRDTAGPRLCALRSGRSAREDVRSRLPRWPRGVGAFQSAQAMVAKQRIRMANEKHSKNITQRGNVAKTLRPQEEKYPVGPWLLALFVFVVCGSAIFQIIQSIRMGM

SEQ ID NO: 764946 - protein, 295 aa, Homo sapiens
MLRSAAGPSSNATPTTTKAKRPVPTPSSRPDPQPSGDAASCLLFILQRGPPCSPHEKFCSGVPQRGALLETLKEKARLVDHTRAARARAWTGSTCVLRSLTTALGPALVQGAAVQGRPRGPACSAAALIPSPGLGWVTGRQTQEGPRPRPRRAHKRRGRPNLRPRSIRLQDRDTAGPRLCALRSGRSAREDVRSRLPRWPRGVGAFQSAQAMVAKQRIRMANEKHSKNITQRGNVAKTLRPQEEKYPVGPWLLALFVFVVCGSGQPHKLASPGDCQNFLKVVTSRGSHPTPKTGN

SEQ ID NO: 764947 - protein, 295 aa, Homo sapiens; identical to SEQ ID NO: 764946

SEQ ID NO: 764948 - protein, 290 aa, Homo sapiens
MLRSAAGPSSNATPTTTKAKRPVPTPSSRPDPQPSGDAASCLLFILQRGPPCSPHEKFCSGVPQRGALLETLKEKARLVDHTRAARARAWTGSTCVLRSLTTALGPALVQGAAVQGRPRGPACSAAALIPSPGLGWVTGRQTQEGPRPRPRRAHKRRGRPNLRPRSIRLQDRDTAGPRLCALRSGRSAREDVRSRLPRWPRGVGAFQSAQAMVAKQRIRMANEKHSKNITQRGNVAKTLRPQEEKYPVGPWLLALFVFVVCGSVSVFSLVYGNKIIVQDPLQIGVVIQEM

SEQ ID NO: 764949 - protein, 139 aa, Homo sapiens
MPGLGERGAQGSGPRLATCSARVGRGGLGGTRSALSQELTQGESLQVGAFQSAQAMVAKQRIRMANEKHSKNITQRGNVAKTLRPQEEKYPVGPWLLALFVFVVCGSGQPHKLASPGDCQNFLKVVTSRGSHPTPKTGN

SEQ ID NO: 764950 - protein, 42 aa, Homo sapiens
MCETRAPKGGVTRDKRRVNTLERKHAGDKGRDTPGGHSGHTR

SEQ ID NO: 764951 - protein, 290 aa, Homo sapiens; identical to SEQ ID NO: 764948

SEQ ID NO: 764952 - protein, 42 aa, Homo sapiens; identical to SEQ ID NO: 764950

SEQ ID NO: 764953 - protein, 335 aa, Homo sapiens
MQGSGKESFKRGSPHGNNQGGFCDDKWGTRYWTELSPWLGRGEAEAHSEMGQPEVMKLVWGIGGSLEMGEAWVLHSLLIHCLLRPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764954 - protein, 296 aa, Homo sapiens
MRPRAPGAYPARAPRPLVPSSRRRPAESPLRSRRCRGDMVLCVQGPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764955 - protein, 305 aa, Homo sapiens
GAGTLGIMGLRPRAPGAYPARAPRPLVPSSRRRPAESPLRSRRCRGDMVLCVQGPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764956 - protein, 296 aa, Homo sapiens; identical to SEQ ID NO: 764954

SEQ ID NO: 764957 - protein, 209 aa, Homo sapiens
ANSLVISCEAVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764958 - protein, 296 aa, Homo sapiens; identical to SEQ ID NO: 764954

SEQ ID NO: 764959 - protein, 157 aa, Homo sapiens
GAGTLGIMGLRPRAPGAYPARAPRPLVPSSRRRPAESPLRSRRCRGDMVLCVQGPRPLLAVERTGQRPLWAPSLELPKPVMQPLPAGAFLEEVAEGTPAQTESEPKVLDPEEDLLCIAKTFSYLRESGWYWGSITASEARQHLLHMRGEKYTSDKTS

SEQ ID NO: 764960 - protein, 358 aa, Homo sapiens
QAGTGRKSFGCARAPREPTQHALRAHWFPPAAAVQPSPHSGVAAAAGTWSSAFRGEHPLVSSGLLLGVREQSFRLLRSKAGTHMYLEHTSHCPHHDDDTAMDTPLPRPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764961 - protein, 296 aa, Homo sapiens; identical to SEQ ID NO: 764954

SEQ ID NO: 764962 - protein, 160 aa, Homo sapiens
MPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 764963 - protein, 183 aa, Homo sapiens
GAGTLGIMGLRPRAPGAYPARAPRPLVPSSRRRPAESPLRSRRCRGDMVLCVQGPRPLLAVERTGQRPLWAPSLELPKPVMQPLPAGAFLEEVAEGTPAQTESEPKVLDPEEDLLCIAKTFSYLRESATAVHLKLVQPFVRRSSARSLQHLCRLVINRLVADVDCLPLPRRMADYLRQYPFQL

SEQ ID NO: 764964 - protein, 655 aa, Homo sapiens [sequence omitted]

SEQ ID NO: 764965 - protein, 166 aa, Homo sapiens
MQASEQAGALQQSKKRGGVGILLSALHNVFQNPQLATRYTLCSPKDMRSWTLPSGLPGNSLHPPQTAALTATSQLRRMRTGLRCTSPSVEDMRCLTRSLRRALDMTQPLRAKQTMIPSLHMSRKLSLWLERTPCMHKCSTYRERPQFLRRKRAQPQSTAPYGNLRW

SEQ ID NO: 764966 - protein, 162 aa, Homo sapiens
MAKYQLPRCLGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 764967 - protein, 641 aa, Homo sapiens [sequence omitted]

SEQ ID NO: 764968 - protein, 633 aa, Homo sapiens
GLYGPEVGISKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQGKTPVSQKEESSATIYCSIRKPQVVPPPQQNDLEIPESPTYENFT

SEQ ID NO: 764969 - protein, 618 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQVVPPPQQNDLEIPESPTYENFT

SEQ ID NO: 764970 - protein, 632 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQVVPPPQQNDLEIPESPTYENFT

SEQ ID NO: 764971 - protein, 737 aa, Homo sapiens
THAEAVTRAEAVVSASSFSLSSENRSSWWHQRVTQMTGLLGLSPVSHRGVSCKYSLLFYRPLSSSCSWAQLLGNISPLHGPEPHCPADRANPVPQRGSQPPGTVAATVLLCSRFLQGFRDDGAGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQGKTPVSQKEESSATIYCSIRKPQVVPPPQQNDLEIPESPTYENFT

SEQ ID NO: 764972 - protein, 684 aa, Homo sapiens
AGTGPEDVMDQRVTQMTGLLGLSPVSHRGVSCKYSLLFYRPLSSSCSWSERKKASSRSLAAPPSPSSISAGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQGKTPVSQKEESSATIYCSIRKPQVVPPPQQNDLEIPESPTYENFT

SEQ ID NO: 764973 - protein, 350 aa, Homo sapiens
GWYRSRGFRKKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTVYAQVFNLQVVPPPQQNDLEIPESPTYENFT

SEQ ID NO: 764974 - protein, 193 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 764975 - protein, 83 aa, Homo sapiens
MESASLLTGRLRKPKITWSLRHSEDGICRISLTCSVEDGGNTVMYTWTPLQKEAVVSQGESHLNVSWRSSENHPNLTCTASNP

SEQ ID NO: 764976 - protein, 1186 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 764977 - protein, 904 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELK

SEQ ID NO: 764978 - protein, 186 aa, Homo sapiens
RKEPESFVLFSFAVLFVSLRVSPSTLRPVPRGCVWLRPGRAGPAVCCLPCALRPGPESSLSLSPQRSGYCKDPSPSSSSTSSYAPSSSSNLSCGGGSSASSTCSKSSFDYTHDMEAAHMAATAILNLSTRCREMPQNLSTKPQDLCATRVRAPGQVEPPGGWGRPGRGPSHRDTRRFRGSCMGQTP

SEQ ID NO: 764979 - protein, 1134 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEKTINMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 764980 - protein, 913 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKRSGYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKTFLIMDKTNFPDKLSLLDPLSS

SEQ ID NO: 764981 - protein, 924 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKIPVQGPRALDHLLMFSDFLN

SEQ ID NO: 764982 - protein, 519 aa, Homo sapiens
SSPPPPPSSAPGQRGGGGGGSSRSSPGCGSRRRRGAPSPVPGRGGGMWGLAGGRLFGIFSAPVLVAVVCCAQSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 764983 - protein, 519 aa, Homo sapiens; identical to SEQ ID NO: 764982

SEQ ID NO: 764984 - protein, 491 aa, Homo sapiens
RRVGGTADPSRLGRRNSAMCSGLLELLLPIWLSWTLGTRGSEPRSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 764985 - protein, 212 aa, Homo sapiens
SSPPPPPSSAPGQRGGGGGGSSRSSPGCGSRRRRGAPSPVPGRGGGMWGLAGGRLFGIFSAPVLVAVVCCAQSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRYYGPGLEEVWHS

SEQ ID NO: 764986 - protein, 271 aa, Homo sapiens
QAVRSRVFRILVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 764987 - protein, 305 aa, Homo sapiens
MLPHFLGGERVRPSPGSSSSGYLPTMALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGLQAPSPSFLDPGLQAPSPSFLIQQSRPQPLLPGPRS

SEQ ID NO: 764988 - protein, 307 aa, Homo sapiens [sequence omitted]

SEQ ID NO: 764989 - protein, 296 aa, Homo sapiens
MLPHFLGGERVRPSPGSSSSGYLPTMALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 764990 - protein, 294 aa, Homo sapiens
MLPHFLGGERVRPSPGSSSSGYLPTMALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGLQAPSPSFLDPGLQAPSPSFLIQQSRPQPLLPGPRS

SEQ ID NO: 764991 - protein, 107 aa, Homo sapiens
MAFLLSLLVLIFLAEFSQSPHIWVSSLLEAGMAETVSCEVARVFPAKEVMFHMFLEDQELSSFLSWEGDTAWANATIRTMEAGDQELSCFASLGAMEQKTRKLVHSY

SEQ ID NO: 764992 - protein, 538 aa, Homo sapiens
RREAQPGQSSAWSRRPAGAPWRSHAGAPQTDPSAMNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 764993 - protein, 514 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 764994 - protein, 514 aa, Homo sapiens; identical to SEQ ID NO: 764993

SEQ ID NO: 764995 - protein, 606 aa, Homo sapiens
RREAQPGQSSAWSRRPAGAPWRSHAGAPQTDPSAMNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTGGAEEVVVGGLVYREAIGTIGTWKGADGRLGWPRAGRRCAWEAVRGGGTDSRPHALSVDAVQSGPHMTPYSLLKEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 764996 - protein, 346 aa, Homo sapiens [sequence omitted]

SEQ ID NO: 764997 - protein, 514 aa, Homo sapiens
ARGSSCAWKASSDPSAMNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 764998 - protein, 548 aa, Homo sapiens
RREAQPGQSSAWSRRPAGAPWRSHAGAPQTDPSAMNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 764999 - protein, 548 aa, Homo sapiens; identical to SEQ ID NO: 764998

SEQ ID NO: 765000 - protein, 255 aa, Homo sapiens
RREAQPGQSSAWSRRPAGAPWRSHAGAPQTDPSAMNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTSAAAHSAAARGAGSPCSRPQPPGSSPWQPCWLQGASL

SEQ ID NO: 765001 - protein, 327 aa, Homo sapiens
MSSGRPLLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 765002 - protein, 354 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFPTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 765003 - protein, 354 aa, Homo sapiens; identical to SEQ ID NO: 765002

SEQ ID NO: 765004 - protein, 81 aa, Homo sapiens
DSGPSELPGPTHTTTGSTYSAITTTHSAPSPLTHTTTGSTHKPIISTLTTTGPTLNIIGPVQTTTSPTHTYAKPSLPCPDA

SEQ ID NO: 765005 - protein, 183 aa, Homo sapiens
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 765006 - protein, 183 aa, Homo sapiens; identical to SEQ ID NO: 765005

SEQ ID NO: 765007 - protein, 183 aa, Homo sapiens; identical to SEQ ID NO: 765005

SEQ ID NO: 765008 - protein, 125 aa, Homo sapiens
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRSSWKLRSGSFSASLEGQPHD

SEQ ID NO: 765009 - protein, 259 aa, Homo sapiens
MPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKQIENTDLEWGGLKY

SEQ ID NO: 765010 - protein, 143 aa, Homo sapiens
MLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKQIENTDLEWGGLKY

SEQ ID NO: 765011 - protein, 259 aa, Homo sapiens; identical to SEQ ID NO: 765009

SEQ ID NO: 765012 - protein, 259 aa, Homo sapiens; identical to SEQ ID NO: 765009

SEQ ID NO: 765013 - protein, 137 aa, Homo sapiens
SRTPEDKQRDSSRPTQTTCTPSKMVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAK

SEQ ID NO: 765014 - protein, 503 aa, Homo sapiens
MALRAKAEVCVAAPWLSLQRARALGTRAARAPRTVLPFEAMPQHPGNRWLRLLQIWREQGYEHLHLEMHQTFQELGPIFRYNLGGPRMVCVMLPEDVEKLQQVDSLHPCRMILEPWVAYRQHRGHKCGVFLLNGPEWRFNRLRLNPDVLSPKAVQRFLPMVDAVARDFSQALKKKVLQNARGSLTLDVQPSIFHYTIEASNLALFGERLGLVGHSPSSASLNFLHALEVMFKSTVQLMFMPRSLSRWIRPKVWKEHFEAWDCIFQYGDNCIQKIYQELAFNRPQHYTGIVAELLLKAELSLEAIKANSMELTAGSVDTTAFPLLMTLFELARNPDVQQILRQESLAAAASISEHPQKATTELPLLRAALKETLRLYPVGLFLERVVSSDLVLQNYHIPAGTLVQVFLYSLGRNAALFPRPERYNPQRWLDIRGSGRNFHHVPFGFGMRQCLGRRLAEAEMLLLLHHVLKHFLVETLTQEDIKMVYSFILRPGTSPLLTFRAIN

SEQ ID NO: 765015 - protein, 87 aa, Homo sapiens
DLLLWVMGQCQEAQARQAQCFRKTAAFREQLQDNCSIPLGILAPNAPRNLAPVSPPGELRGPPLHTLAGFLFDLFNFQEPSLLESRI

SEQ ID NO: 765016 - protein, 160 aa, Homo sapiens
AVPPAEARQQRPVCLCWPEDGAHGHTLALQMSLVLLLVTPDYRLAPQSHPSPPEKGAQDTLDPKSSASRDFQTGAHPLTPPGWQLQLSLSAWKGTLWDTEGTRFLRLSLQSLPFSEDRSCWSRTSSSSTWLKLGQSVWFSQGWLDPRTEDQSPLIAWPWR

SEQ ID NO: 765017 - protein, 66 aa, Homo sapiens
NGSKPTWGLSTKTRYFTSWKYHNSSSSCDNQKCIQTSPMSPGVWGGNLLKLRTTALEIKAVRNPRY

SEQ ID NO: 765018 - protein, 280 aa, Homo sapiens
RQSEQPWSRRSSSSSSRRRLRSAAEPAMALSMPLNGLKEEDKEPLIELLVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 765019 - protein, 80 aa, Homo sapiens
RQSEQPWSRRSSSSSSRRRLRSAAEPAMALSMPLNGLKEEDKEPLIELLVKAGSDGESIGNCPFSQRLFMILGSKELYLV

SEQ ID NO: 765020 - protein, 280 aa, Homo sapiens
RQSEQPWSRRSSSSSSRRRLRSAAEPAMALSMPLNGLKEEDKEPLIELLVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTRGWGGGGGGGGIGDVGGDSPSK

SEQ ID NO: 765021 - protein, 50 aa, Homo sapiens
NRTASETARLPIINPVWLRNCQAPHHKSCVATNGENSRKWKETNCPVGKT

SEQ ID NO: 765022 - protein, 69 aa, Homo sapiens
DEPGHYYGAVCLEYRLGSFQKEVSSKQTHLEREKCAYYIHINSIHAASLSFSLSLSHSRIELHTNMSFV

SEQ ID NO: 765023 - protein, 376 aa, Homo sapiens
MQKTDIHYHSLTGEADFNWRFIFTMDYLAAERTCVQSQKVTGLGREGQQATTNRPRLLELLPPPLQRLAICPRTSETCPQVETLFLDSLSLLGGGPLRGARETSRRQAGEHALPPFPQDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 765024 - protein, 1891 aa, Homo sapiens
MLSHEVTRIEKHQNRQKYGLCVIFLSCTMMPNFKELIHFEVSIGHYGNKMDLNYKPLVSSTPYSPVIYDGNIYHYVPWYNTKPVVAVTSNWEDVSFRMNCLNLLHFTRDRLKANLDTLKSTRNPKDPALLYQWEKLLRELAEDCKRPLPCMTYQPKATSLDRKRWQLRSLLLQELAQKAKQAKPKDMVATAEDWLYRLNTVLPEPQMGLPDVMIWLVAKEQRVAYAQYPEGEGQKDVLPAHLRVCMWLGNVTDSKDLQLLRQGDTAVYAEMVSDENQAKYKDQWGQQGLYHCPNFSDVMGNKTLPMTDFQPPLGWHWQDSWTVEPQRRLLLDIDINKSQVLEEVYENQGRDTRGAWGPAAIPNTDVNGQPMEARENVKCPQGWHFKKDWVVELNHAVDSKGWEYGVGIPPSGLPQVWSPVEKTYHSCRRRRWARVRFRNHGELSHEQETLSFLQLGLAKGEEEGWEYDTFGSKFHLNPQPQSRFRRRCWRRRLAPNKDKGIAPIFLLEGSLAMDLKYHAGKEEDSKTWPWGLDRQFRDPQRQDTRPPNLPFIYCTFNKPHYYQLFCYIYQARNLVSNQILTFQGPFIRVVFLNHSQCTQTLRSSAGPTWAQTLIFQHLLLYENPQDTKESPPLVVLELWQRDFWGKESLWGRSVWPPMVWLDLQDRILPPMRWHPLVKELGKEEGEILASCELILQTEKLGEKQLPILSVPWKNGAYTLPKSIQPTIKRMAIEVLAMWDGDGGQDRRGWSGVRCSLLLVLPDYWIQSSHPEKDYLGGGGRQERNEEVLVYTLEIILPQTSAVRSRQRAVACMITVGLTLPLRSSNYFAEKEIEAPRDNTFHSTVMQGLTDEAISGPALSDCRCQDVAHLSSESSMRVLIQKLCALPQMWQRAQDGQASGTEGFPKIRQLGWFPLYGPEEAQSQGAAISWQDARSLNGHGVLNELDGTGALRNPGTSCFFRPQRQSASGTPTSELMRPDKAAGEEGQCLRAMEVSGGCSQWPEVTSLMGWGTASQPRGQALIPHRTGKPVLVRLQTLAPLQPHSLALQAPAAPAIAPQPPSLARTPLQRRCLPLVLPSFFVLVDPGLGLRNMKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPTLSEKKHQDFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 765025 - protein, 128 aa, Homo sapiens [sequence omitted]

SEQ ID NO: 765026 - protein, 521 aa, Homo sapiens
PRVRARTAKMKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 765027 - protein, 97 aa, Homo sapiens
EDPSSYDTTRGVLFCGIVILSMIIALIVTARSNNKTKHIEEENLIDEDFQNLKLRSTGFTNLGAEGSVFPKVRITASRDSQMQNPYSRHSSMPRPDY

SEQ ID NO: 765028 - protein, 86 aa, Homo sapiens
RSHESAFLTDGHFTDKCHYEVLTTSAPGATETLYCELFQNLKLRSTGFTNLGAEGSVFPKVRITASRDSQMQNPYSRHSSMPRPDY

SEQ ID NO: 765029 - protein, 521 aa, Homo sapiens; identical to SEQ ID NO: 765026

SEQ ID NO: 765030 - protein, 521 aa, Homo sapiens; identical to SEQ ID NO: 765026

SEQ ID NO: 765031 - protein, 379 aa, Homo sapiens
PRVRARTAKMKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVGVGKCFTCF

SEQ ID NO: 765032 - protein, 383 aa, Homo sapiens
PRVRARTAKMKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVAQAMLNKEEWWGP

SEQ ID NO: 765033 - protein, 314 aa, Homo sapiens
RPLAIGTNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 765034 - protein, 129 aa, Homo sapiens
GTLTCSPQGLFNTVSYCSLYFRCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 765035 - protein, 521 aa, Homo sapiens; identical to SEQ ID NO: 765026

SEQ ID NO: 765036 - protein, 116 aa, Homo sapiens
LSVADSRLKLRTSILINALGSNTCLAKVDLSGNGMEDIGAKMLSKALQINSSLRTILWDRNNTSALGFLDIARALESNHTLRFMSFPVSDISQAYRSAPERTEDVWQKIQWCLVRN

SEQ ID NO: 765037 - protein, 130 aa, Homo sapiens
IYLPIPDVHVKDNLWAFVSDTAELCAVAAHPCCGRAWCRGGAPLLQQASEHSPPCGRVMRVMHPSADGHLNGLCLALCSAAVNTDLRVSWRRVGISRAYLGVGRCTAFCLETSPLKIIVSYSLLGKLLGF

SEQ ID NO: 765038 - protein, 107 aa, Homo sapiens
YPLLLSLLQVTPAMRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 765039 - protein, 1311 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765040 - protein, 129 aa, Homo sapiens
TGDTGYGYSRVLAEGGFAFVYEAQDVGSGREYALKRLLSNEEEKNRAIIQEVCFMKKLSGHPKAPVLAAVSTPVSNSPPGLPALTVGPPSGHLPVYEKAFSPDCFLTLPPWPPCGAIPACADSTARQKC

SEQ ID NO: 765041 - protein, 1333 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIQGVASGGSVTSASAGGADPPGEPWGRARCASAAGAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765042 - protein, 1164 aa, Homo sapiens
MESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765043 - protein, 1129 aa, Homo sapiens
SPLLFPQAPVSPLHFPCSRYHPCVPCSPQCHPCAPHGSDVTPAFPVGLGITPALPAGPGVTPALPVGLGITLLSPQALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765044 - protein, 1367 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLLHSPLRALPPPATRGMDFGVAVVSAQNCGHGYVRSPLTRQLQKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765045 - protein, 1311 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLLHSPLRALPPPATRGMDFGVAVVSAQNCGHGYVRSPLTRQLQKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLQGHAAGAHGPWCLHRTL

SEQ ID NO: 765046 - protein, 579 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765047 - protein, 443 aa, Homo sapiens
MSAVLLLTPLSPWARASPLLSPQTWESPLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765048 - protein, 354 aa, Homo sapiens
ASCRIGTRPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765049 - protein, 288 aa, Homo sapiens [sequence omitted]

SEQ ID NO: 765050 - protein, 180 aa, Homo sapiens
LEAGRQRLQRAEITPLHSGLGDRVETLSQTKKSFCSFLAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765051 - protein, 264 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEKLLWVRPLWSGALVPGETPFSSASGLGAQQANTSVPTCHEAREAVGD

SEQ ID NO: 765052 - protein, 142 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKAPRPGSRAGAAGLGF

SEQ ID NO: 765053 - protein, 288 aa, Homo sapiens [sequence omitted]

SEQ ID NO: 765054 - protein, 1367 aa, Homo sapiens; identical to SEQ ID NO: 765044

SEQ ID NO: 765055 - protein, 1425 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEKLLWVRPLWSGALVPGETPFSSASGLGAQQANTSVPTCHEAREAVGDLREVNDSVLIVKERAEAEDEQRSWCMGPTGLRSSRGIVCGTGCPSVCCAFGKLHGSGATEKILFVGCNFSFEMFVFFQITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765056 - protein, 1076 aa, Homo sapiens [sequence omitted]

SEQ ID NO: 765057 - protein, 1367 aa, Homo sapiens; identical to SEQ ID NO: 765044

SEQ ID NO: 765058 - protein, 1342 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLLHSPLRALPPPATRGMDFGVAVVSAQNCGHGYVRSPLTRQLQKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKVSRAARRP

SEQ ID NO: 765059 - protein, 1129 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLLHSPLRALPPPATRGMDFGVAVVSAQNCGHGYVRSPLTRQLQKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEEAPHPKD

SEQ ID NO: 765060 - protein, 454 aa, Homo sapiens
MSAVLLLTPLSPWARASPLLSPQTWESPLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765061 - protein, 586 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLLHSPLRALPPPATRGMDFGVAVVSAQNCGHGYVRSPLTRQLQKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAV

SEQ ID NO: 765062 - protein, 265 aa, Homo sapiens
SGDPPNPKEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 765063 - protein, 219 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEVS

SEQ ID NO: 765064 - protein, 123 aa, Homo sapiens
MKTTWPCVVRSGLYIVEGRACSGTVSVSRAEPTPRDQALPQRRASVSAVQRRRAGRCPGLGKLRVSQQLLDWIEGKERNIRALLSTLHTVLWDGESRWTPVGMADLVAPEQVKKHYRRAVLAV

SEQ ID NO: 765065 - protein, 111 aa, Homo sapiens
DLPQCNTTSKRRVRFQEIDDSLDHDEVGGGSCILLVLLCIATVFLSVGGTALYCTFGDMESPVCTDFADNMDFYYTKLLQGVAELKHWIYLSQQHSRHRHAGSESERRETF

SEQ ID NO: 765066 - protein, 111 aa, Homo sapiens; identical to SEQ ID NO: 765065

SEQ ID NO: 765067 - protein, 111 aa, Homo sapiens; identical to SEQ ID NO: 765065

SEQ ID NO: 765068 - protein, 111 aa, Homo sapiens; identical to SEQ ID NO: 765065

SEQ ID NO: 765069 - protein, 111 aa, Homo sapiens; identical to SEQ ID NO: 765065

SEQ ID NO: 765070 - protein, 111 aa, Homo sapiens; identical to SEQ ID NO: 765065

SEQ ID NO: 765071 - protein, 111 aa, Homo sapiens; identical to SEQ ID NO: 765065

SEQ ID NO: 765072 - protein, 252 aa, Homo sapiens
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 765073 - protein, 111 aa, Homo sapiens
VYKCLAQSLAHRKCSVNSTSHQILGMNESECLALHIRKDVAANHPPDMTCCVGAFTSLFLLKDSKLCWSYWCTFVRPALTTAPLGRALLYEVAVFPGRLVNPYNVKKKEAM

SEQ ID NO: 765074 - protein, 243 aa, Homo sapiens
VNMAEYGGVHLFIITCIIMKRDRAPRYSRESQRAWRVERSKSYNQRPLYVTVKLSLYKDLTCLDSYVNDEFQGTNGTSLEQSLCLIDGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVAHYGWPI

SEQ ID NO: 765075 - protein, 390 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765076 - protein, 355 aa, Homo sapiens
MLLLYTKISNLFWIHMLMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765077 - protein, 285 aa, Homo sapiens
MAVSESQLKKMVSKPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765078 - protein, 271 aa, Homo sapiens
MVKASRVAKAPSSARSDNTAAQPADDAGARCWPASGGCTPYSSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765079 - protein, 390 aa, Homo sapiens; identical to SEQ ID NO: 765075

SEQ ID NO: 765080 - protein, 387 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKSTEDWSEQGKRSGLVAAVLCPQAALR

SEQ ID NO: 765081 - protein, 387 aa, Homo sapiens; identical to SEQ ID NO: 765080

SEQ ID NO: 765082 - protein, 180 aa, Homo sapiens
MLFQRIPSTFSHRDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765083 - protein, 315 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSAHAYRDIHLGNIHFR

SEQ ID NO: 765084 - protein, 119 aa, Homo sapiens
IIEVGTLSRGAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765085 - protein, 220 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVAHYGWPI

SEQ ID NO: 765086 - protein, 248 aa, Homo sapiens
MLLLYTKISNLFWIHMLMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGAAATVAAATAGTATAARGVGLGKKWSPHLELCSEASSSPAALPRERLDKSELVQKANSLSRLSAMMIWL

SEQ ID NO: 765087 - protein, 390 aa, Homo sapiens; identical to SEQ ID NO: 765075

SEQ ID NO: 765088 - protein, 390 aa, Homo sapiens; identical to SEQ ID NO: 765075

SEQ ID NO: 765089 - protein, 421 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHRWDFAMLAQLVSNSWLQAVHPPWPPKVLGLQPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765090 - protein, 225 aa, Homo sapiens
MLMQMGRYIFLIYMNGNTGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765091 - protein, 233 aa, Homo sapiens
PSGYPGLGGYPDGYGEIPPGMPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 765092 - protein, 390 aa, Homo sapiens; identical to SEQ ID NO: 765075

SEQ ID NO: 765093 - protein, 398 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQLEVELFLKYSSLPFISRCPE

SEQ ID NO: 765094 - protein, 348 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDIQVYHAPR

SEQ ID NO: 765095 - protein, 283 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGAAATVAAATAGTATAARGVGLGKKWSPHLELCSEASSSPAALPRERLDKSELVQKANSLSRLSAMMIWL

SEQ ID NO: 765096 - protein, 184 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSG

SEQ ID NO: 765097 - protein, 212 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGDYLLESVNKLFGEKSASFREEYIRLCQKYYSSEPQAVDFLECAEEARKKINSWVKTQTKGKIPNLLPEGSVDGDTKDGPGECCLLQRKVENSI

SEQ ID NO: 765098 - protein, 212 aa, Homo sapiens; identical to SEQ ID NO: 765097

SEQ ID NO: 765099 - protein, 201 aa, Homo sapiens
ESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEMMVLVNAVYFKGKWKTPFEKKLNGLYPFRVNSAQRTPVQDDVLA

SEQ ID NO: 765100 - protein, 524 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 765101 - protein, 484 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 765102 - protein, 524 aa, Homo sapiens; identical to SEQ ID NO: 765100

SEQ ID NO: 765103 - protein, 125 aa, Homo sapiens
KGRPGCDSLGCRRPPARWPRGVRGKHPCLWLVAGAWRVRTPARPRRLPAAAASLNRGVVFVFDPRAPVARGRGRCRRGGAVAAEAEEEGAGALRGRAPPWNWARSPRTAAACSSPAAPLPRRSPS

SEQ ID NO: 765104 - protein, 518 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 765105 - protein, 524 aa, Homo sapiens; identical to SEQ ID NO: 765100

SEQ ID NO: 765106 - protein, 109 aa, Homo sapiens
MLKLTPLPSKMKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 765107 - protein, 109 aa, Homo sapiens; identical to SEQ ID NO: 765106

SEQ ID NO: 765108 - protein, 109 aa, Homo sapiens; identical to SEQ ID NO: 765106

SEQ ID NO: 765109 - protein, 72 aa, Homo sapiens
PGPSPKDQGLISSRDQWPTVLCRIFKVFHLIVPSLPHSFKTKRGKEVCADPKERWVRDSMKHLDQIFQNLKP

SEQ ID NO: 765110 - protein, 342 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 765111 - protein, 342 aa, Homo sapiens; identical to SEQ ID NO: 765110

SEQ ID NO: 765112 - protein, 342 aa, Homo sapiens; identical to SEQ ID NO: 765110

SEQ ID NO: 765113 - protein, 324 aa, Homo sapiens
MEPHDSSHMDSEFRYTLFPIVYSIIFVLGVIANGYVLWVFARLYPCKKFNEIKIFMVNLTMADMLFLITLPLWIVYYLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 765114 - protein, 274 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 765115 - protein, 1849 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 765116 - protein, 1891 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEVSVLMQQLSPSINVGIFFQCREVTSMCREVGMRGNKRKRYEKMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 765117 - protein, 1891 aa, Homo sapiens; identical to SEQ ID NO: 765116

SEQ ID NO: 765118 - protein, 1221 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEVSVLMQQLSPSINVGIFFQCREVTSMCREVGMRGNKRKRYEKMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALAYISQSSKDG

SEQ ID NO: 765119 - protein, 350 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEVSVLMQQLSPSINSWHLFPM

SEQ ID NO: 765120 - protein, 1849 aa, Homo sapiens; identical to SEQ ID NO: 765115

SEQ ID NO: 765121 - protein, 1873 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEVSVLMQQLSPSINVGIFFQCREVTSMCREVGMRGNKRKRYEKMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 765122 - protein, 1269 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEVSVLMQQLSPSINVGIFFQCREVTSMCREVGMRGNKRKRYEKMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEVSQRYLL

SEQ ID NO: 765123 - protein, 350 aa, Homo sapiens; identical to SEQ ID NO: 765119

SEQ ID NO: 765124 - protein, 103 aa, Homo sapiens
LVSWGCHNKVPQTGWLKTTEICALMVQEARSLKSRCQQGWFLPGVSERETVPHTSFLSFCWCLAILGTPRLVAASLQSLPPLSYGLCVSVSKSFLLSSNSHWI

SEQ ID NO: 765125 - protein, 487 aa, Homo sapiens
MSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 765126 - protein, 379 aa, Homo sapiens
MSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGEAVCAAAGRARA

SEQ ID NO: 765127 - protein, 379 aa, Homo sapiens; identical to SEQ ID NO: 765126

SEQ ID NO: 765128 - protein, 195 aa, Homo sapiens
SACTDCICAPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGEAVCAAAGRARA

SEQ ID NO: 765129 - protein, 77 aa, Homo sapiens
KLRPFGCPVGGCGKKFTTVYNLKAHMKGHEQESLFKCEVCAERFPTHAKLSSHQRSTSSPSALTSVTFPAVRRHLSQ

SEQ ID NO: 765130 - protein, 135 aa, Homo sapiens
MSKLLRHRRKHDDDRRFTCPVEGCGKSFTRAEHLKGHSITHLGTKPFECPVEGCCARFSARSSLYIHSKKHVQDVGAPKSRCPVSTCNRLFTSKRCSPHLEALLDRRPPSSQEALSTCRICSDGSLGLGRPKATV

SEQ ID NO: 765131 - protein, 241 aa, Homo sapiens
MQVQDRRSVGQMKFLAWTVRGLAASPLRSPSTCPGPSSWPVGKLGHAGKALCGARGFAGEHCGYTRLVGVQGVPGHLQGVEERALGGKSVFGLTEGRSWRAEGSRPSKSCWDQGDRMRTRWEQVVPSPHKQFLLGPRASLGIQGVGWFCHALQLEETSQVRRGPLLHSHRHVTGLSVLPSQDDPSGEGVLPSARGPATFLPFLTVDLPVYVLQEVLPSSGGPAGPEATQFPGSTINLQDLQ

SEQ ID NO: 765132 - protein, 563 aa, Homo sapiens
SRGLYLNGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 765133 - protein, 514 aa, Homo sapiens
MKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 765134 - protein, 339 aa, Homo sapiens [sequence omitted]

SEQ ID NO: 765135 - protein, 107 aa, Homo sapiens [sequence omitted]

SEQ ID NO: 765136 - protein, 93 aa, Homo sapiens
SPETLPAETSQVRRGPLLHSHRHVTGLSVLPSQDDPSGEGVLPSARGPATFLPFLTVDLPVYVLQEVLPSSGGPAGPEATQFPGSTINLQDLQ

SEQ ID NO: 765137 - protein, 88 aa, Homo sapiens
LGTNPRKGLGVDPIPPKLVSEVEELYKSITALREKLLQAEQSLRNLKDIHMSLEKDVTAMTNSLFIDRQKCMAHRTCYPTILQLAGYQ

SEQ ID NO: 765138 - protein, 150 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDVRHKLQHHLHKVGHPEPRRRLRRLPTTLPPLITWPGPSTPFSSVPLIPRDPRSKCHLSVNLCKTR

SEQ ID NO: 765139 - protein, 150 aa, Homo sapiens; identical to SEQ ID NO: 765138

SEQ ID NO: 765140 - protein, 124 aa, Homo sapiens
MLCPRAAFLVGSFHGVFPGPPASSHWEFWVPSTPVGAYFCPPQPQLTPPNTPKLVSEVEELYKSITALREKLLQAEQSLRNLKDIHMSLEKDVTAMTNSLFIDRQKCMAHRTCYPTILQLAGYQ

SEQ ID NO: 765141 - protein, 208 aa, Homo sapiens
MGVLGPELRDNRLPDSPEPAGGPVHIVPLTHASPGPLVRTTLWTQPQELGRTRLVSTFHMPGHGGTGPRGTVLSADAAGNHRSGTQRGGTEGGHQGQGGTSAHSPDPAVAALTPAQHAAVPRCSPVQPQLTPPNTPKLVSEVEELYKSITALREKLLQAEQSLRNLKDIHMSLEKDVTAMTNSLFIDRQKCMAHRTCYPTILQLAGYQ

SEQ ID NO: 765142 - protein, 206 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDVRHKLQHHLHKMLREITDQEHNVVALKEAIKDKEEPLHIAQTRLYLLSHRPNMQLCREAAQFRALWEKLLEGEQSLCNLEDIHMSLEKDVTAMTNSLFIDRQKCMAHRTCYTPILQLAGYQ

SEQ ID NO: 765143 - protein, 219 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDVRHKLQHHLHKMLREITDQEHNVVALKEAIKDKEEPLHIAQTRLYLLSHRPNMQLCREAAQFSWLSEVEELNMSITALWEKLLEGEQSLCNLEDIHMSLEKDVTAMTNSLFIDRQKCMAHRTCYTPILQLAGYQ

SEQ ID NO: 765144 - protein, 144 aa, Homo sapiens
MLPVLRDFGKSFLVYEDDVQDVGLVSLRQTNRSMAGSRSFLDSLAKELTDVLEGISGEVDGLVKFQGPGEADRKTGTVLMLFLSALCMSSDVAVNSWAVQDEAAWPVYIFLDEALEASVVLSTLKGAVPTEGCLKVSQKRRKSL

SEQ ID NO: 765145 - protein, 129 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDARHKLQHHLHKMLREITDQEHNVVALKEAIKDKEEPLHIAQTRL

SEQ ID NO: 765146 - protein, 129 aa, Homo sapiens
MFPVSSGCFQEQQETNKSLPRSASTPETRTKFTQDNLCHAQRERLDSANLWVLVDCILRDTSEDLGLQCDAVNLAFGRRCEELEDVRHKLQHHLHKMLREITDQEHNVVALKEAIKDKEEPLHIAQTRL

SEQ ID NO: 765147 - protein, 150 aa, Homo sapiens; identical to SEQ ID NO: 765138

SEQ ID NO: 765148 - protein, 129 aa, Homo sapiens; identical to SEQ ID NO: 765146

SEQ ID NO: 765149 - protein, 237 aa, Homo sapiens
MSLWLCFQCPLGVSKSNKKRINLWDPVDGAQYLRLRKRFWWGLRLRPRPWGLSRVHVNAERSIHHPLPETAVPEVLHRQGRAGQGGAQPLNEAALSGGDARRARRLHQPLPQMQDLRPERTWSPRPTVARRRTGAAPGGATAPRPFRQNLSDLGRRSALPLKRNLCAGGSSLGAPPPRTPQRRVTLAAQRWLSRPRRRAVGLGELDQWSTGGCSRPPMGSGQLGGCPHAQPDAGHSG

SEQ ID NO: 765150 - protein, 534 aa, Homo sapiens
ALPLTGGCRTLYTQTAVQHGRWAEARVNMPANGTSPQRFPALIPGEPGRSFEGSVSFEDVAVDFTRQEWHRLDPAQRTMHKDVMLETYSNLASVGLCVAKPEMIFKLERGEELWILEEESSGHGYSGSLSLLCGNGSVGDNALRHDNDLLHHQKIQTLDQNVEYNGCRKAFHEKTGFVRRKRTPRGDKNFECNECGKAYCRKSNLVEHLRIHTGERPYECGECAKTFSARSYLIAHQKTHTGERPFECNECGKSFGRKSQLILHTRTHTGERPYECTECGKTFSEKATLTIHQRTHTGEKPYECSECGKTFRVKISLTQHHRTHTGEKPYECGECGKNFRAKKSLNQHQRIHTGEKPYECGECGKFFRMKMTLNNHQRTHTGEKPYQCNECGKSFRVHSSLGIHQRIHTGEKPYECNECGNAFYVKARLIEHQRMHSGEKPYECSECGKIFSMKKSLCQHRRTHTGEKPYECSECGNAFYVKVRLIEHQRIHTGERPFECQECGKAFCRKAHLTEHQRTHIGWSWRCTMKKASH

SEQ ID NO: 765151 - protein, 400 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 765152 - protein, 400 aa, Homo sapiens; identical to SEQ ID NO: 765151

SEQ ID NO: 765153 - protein, 400 aa, Homo sapiens; identical to SEQ ID NO: 765151

SEQ ID NO: 765154 - protein, 400 aa, Homo sapiens; identical to SEQ ID NO: 765151

SEQ ID NO: 765155 - protein, 400 aa, Homo sapiens; identical to SEQ ID NO: 765151

SEQ ID NO: 765156 - protein, 269 aa, Homo sapiens [sequence omitted]

SEQ ID NO: 765157 - protein, 400 aa, Homo sapiens; identical to SEQ ID NO: 765151

SEQ ID NO: 765158 - protein, 75 aa, Homo sapiens
PTYHHQHPTKNLYERENAGQTPMNINPQQTRFPDFLDCLPGTNVDLGTLESEDLIPLFNDVESALNKSEPFLTWL

SEQ ID NO: 765159 - protein, 400 aa, Homo sapiens; identical to SEQ ID NO: 765151

SEQ ID NO: 765160 - protein, 400 aa, Homo sapiens; identical to SEQ ID NO: 765151

SEQ ID NO: 765161 - protein, 400 aa, Homo sapiens; identical to SEQ ID NO: 765151

SEQ ID NO: 765162 - protein, 400 aa, Homo sapiens; identical to SEQ ID NO: 765151

SEQ ID NO: 765163 - protein, 269 aa, Homo sapiens [sequence omitted]

SEQ ID NO: 765164 - protein, 274 aa, Homo sapiens
PPTRRGRVGGTGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 765165 - protein, 225 aa, Homo sapiens
KPAPQPAESATRRMGAALMVLARKWRLERSCRPGRQGRQEKLAGLAGEARIGRRKKGFAKLAAQRDGCIGGAGRGWRLVRAGCAHWERLESCLAQFAGLLCKRAARSDERPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 765166 - protein, 400 aa, Homo sapiens; identical to SEQ ID NO: 765151

SEQ ID NO: 765167 - protein, 400 aa, Homo sapiens; identical to SEQ ID NO: 765151

SEQ ID NO: 765168 - protein, 251 aa, Homo sapiens
TLPLRWQRNTWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYFTPRSWGKLLPRGRILIRDGAYKVPCPLNLDKCLSVPLGEALPNWVLE

SEQ ID NO: 765169 - protein, 318 aa, Homo sapiens
GIQGEIQKFCQTYGLRPCSTNPYITLSPQDINTKWDMVRKLVPSRDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 765170 - protein, 91 aa, Homo sapiens
QVVASFKILAGDKVSPRRWRGWWARAGHGTCGLNASSPQNYITPEELRRELPAKQAEYCIRRMVPYKGSGAPAGALDYVAFSSALYGESDL

SEQ ID NO: 765171 - protein, 348 aa, Homo sapiens
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765172 - protein, 390 aa, Homo sapiens
GCTVWKLRIVGRGNPSRTLQSSVTLDKEVWILRFHLFQLQGAMAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765173 - protein, 348 aa, Homo sapiens; identical to SEQ ID NO: 765171

SEQ ID NO: 765174 - protein, 348 aa, Homo sapiens; identical to SEQ ID NO: 765171

SEQ ID NO: 765175 - protein, 348 aa, Homo sapiens; identical to SEQ ID NO: 765171

SEQ ID NO: 765176 - protein, 284 aa, Homo sapiens [sequence omitted]

SEQ ID NO: 765177 - protein, 400 aa, Homo sapiens
MAEKVLVTGGAGYIGSHTVLELLEAGYLPVVIDNFHNAFRGERGSGAGGYLRGWQKQNPGFHLHHRAGNVCLASPWEHSTPCRDDVAYMYPTRGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765178 - protein, 314 aa, Homo sapiens
GCTVWKLRIVGRGNPSRTLQSSVTLDKEVWILRFHLFQLQGAMAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRGRKRREK

SEQ ID NO: 765179 - protein, 331 aa, Homo sapiens
MAEKVLVTGGAGYIGSHTVLELLEAGYLPVVIDNFHNAFRGGGSLPESLRRVQELTGRSVEFEEMDILDQGALQRLFKKSVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765180 - protein, 221 aa, Homo sapiens
HTHPQSSVDLVLIGRGPDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765181 - protein, 314 aa, Homo sapiens; identical to SEQ ID NO: 765178

SEQ ID NO: 765182 - protein, 140 aa, Homo sapiens [sequence omitted]

SEQ ID NO: 765183 - protein, 314 aa, Homo sapiens; identical to SEQ ID NO: 765178

SEQ ID NO: 765184 - protein, 390 aa, Homo sapiens; identical to SEQ ID NO: 765172

SEQ ID NO: 765185 - protein, 284 aa, Homo sapiens [sequence omitted]

SEQ ID NO: 765186 - protein, 477 aa, Homo sapiens
MAEKVLVTGGAGYIGSHTVLELLEAGYLPVVIDNFHNAFRGGGSLPESLRRVQELTGRSVEFEEMDILDQGALQRLFKKGGCRLGTVAHACNSSTLEGRGEEITGAQVFKTSLLNTVKPHLYRKIQKLAGHGSPYLWSQLLGRLAWEDGLSLGGGGCGELRWHHCTPAWTTERDCQKKKQQVSAGRQAEGIAKDYKPVEQPLAMSPLQYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765187 - protein, 274 aa, Homo sapiens
MSPLQYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 765188 - protein, 364 aa, Homo sapiens
GCTVWKLRIVGRGNPSRTLQSSVTLDKEVWILRFHLFQLQGAMAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIPYKVVARREGDVAACYANPSLAQEELGWTAALGLDRMCEDLWRWQKQNPSGFGTQA

SEQ ID NO: 765189 - protein, 145 aa, Homo sapiens
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKVPMPLAALVRIPRAYPTTSCLMSPRWRSGDGRP

SEQ ID NO: 765190 - protein, 390 aa, Homo sapiens; identical to SEQ ID NO: 765172

SEQ ID NO: 765191 - protein, 670 aa, Homo sapiens
MASGSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKYRWGFSSVVRLDSNSRPQAEDADEVMGKYLSEKLKLKDKWLGVWKTNPSVFFVKYEEASIPFVGILVEVTCEPYQDSSSRFKVTVSVAEPFSSNIANIPRDWLMRFWRNWNTVCLFWKCILLRDKILIYMLLLWPWKLSGFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 765192 - protein, 652 aa, Homo sapiens
MASGSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRFKVTVSVAEPFSSNIANIPRDWLMRFWRNWNTVCLFWKCILLRDKILIYMLLLWPWKLSGFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 765193 - protein, 728 aa, Homo sapiens
MASGSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKVSGSGTGRLRSEARRNLGTGIWGFPLRRMGIHRAQRKLAFQKSKWSQHVYEQFTLLEVPASCPRGVKVRVSDKIRQAEDADEVMGKYLSEKLKLKDKWLGVWKTNPSVFFVKYEEASIPFVGILVEVTCEPYQDSSSRFKVTVSVAEPFSSNIANIPRDWLMRFWRNWNTVCLFWKCILLRDKILIYMLLLWPWKLSGFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 765194 - protein, 86 aa, Homo sapiens
PVESDLTCRLRGSKEEYVTCGAGCAQTRCAGSCRRSEPKGDGGRKWSVSDHQTRMRVNWEKMVRPPHPENPPPPAHTPSEHPGGGL

SEQ ID NO: 765195 - protein, 179 aa, Homo sapiens
EATLVGDRTTGLGGAQGLPDPPLPSQEILEAGVGVFLIWTSETHEKLSQMCLNTEWVEMKSKALLNEETVSSGIIERVTGLPATGFGAVFPRHPPDWSKMCALTTYSEDYVPPYDYQPHAYPCQDDYSIVHRKCRSQFTDLNGSKRFGINTWHDESGIYANSDVKQKLYPLTSGPIVPI

SEQ ID NO: 765196 - protein, 125 aa, Homo sapiens
EATLVGDRTTGLGGAQGLPDPPLPSQEILEAGVGVFLIWTSETHEKLSQMCLNTEWVEMKSKALLNEETVSSGIIERVTGLPATGFGAVFPRHPPDWSKMLVVPKLLQLYKMFLDSEGLFAGAKV

SEQ ID NO: 765197 - protein, 161 aa, Homo sapiens
KQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLVVPKLLQLYKMFLDSEGLFAGAKV

SEQ ID NO: 765198 - protein, 179 aa, Homo sapiens; identical to SEQ ID NO: 765195

SEQ ID NO: 765199 - protein, 145 aa, Homo sapiens
KQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLIPVKMIIP

SEQ ID NO: 765200 - protein, 125 aa, Homo sapiens; identical to SEQ ID NO: 765196

SEQ ID NO: 765201 - protein, 281 aa, Homo sapiens
AGVRTASRDPGAGFRRTANKRCCRRRFLIGCGWLPLRSDWPLVSKMLSKGLKRKREEEEEKEPLAVDSWWLDPGHTAVAQAPPAVASSSLFDLSVLKLHHSLQQSEPDLRHLVLVVNTLRRIQASMAPAAALPPVPSPPAAPSVADNLLASSDAALSASMASLLEDLSHIEGLSQAPQPLADEGPPGRSIGGAAPSLGALDLLGPATGCLLDDGLEGLFEDIDTSMYDNELWAPASEGLKPGPEDGPGKEEAPELDEAELDYLMDVLVGTQALERPPGPGR

SEQ ID NO: 765202 - protein, 87 aa, Homo sapiens
AGVRTASRDPGAGFRRTANKRCCRRRFLIGCGWLPLRSDWPLVSKMLSKGLKRKREEEEEKEPLAVDSWWLDPGHTAVVQEHGGLAL

SEQ ID NO: 765203 - protein, 281 aa, Homo sapiens; identical to SEQ ID NO: 765201

SEQ ID NO: 765204 - protein, 209 aa, Homo sapiens
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWRPEEPIEVIRPDIAALVRQVIIKKKEDL

SEQ ID NO: 765205 - protein, 158 aa, Homo sapiens [sequence omitted]

SEQ ID NO: 765206 - protein, 209 aa, Homo sapiens; identical to SEQ ID NO: 765204

SEQ ID NO: 765207 - protein, 210 aa, Homo sapiens
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWRPEEPIEVIRPDIAALVRQVIIKKKKNST

SEQ ID NO: 765208 - protein, 209 aa, Homo sapiens; identical to SEQ ID NO: 765204

SEQ ID NO: 765209 - protein, 209 aa, Homo sapiens; identical to SEQ ID NO: 765204

SEQ ID NO: 765210 - protein, 69 aa, Homo sapiens
RSACREGALGGAAGRGSHRYELGRPSNQRRRAVRGNLKCLTGWPGDGVSGSRAPGRPGRLQCPGERQEN

SEQ ID NO: 765211 - protein, 374 aa, Homo sapiens
MAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 765212 - protein, 374 aa, Homo sapiens; identical to SEQ ID NO: 765211

SEQ ID NO: 765213 - protein, 355 aa, Homo sapiens
VNVRLSLADPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 765214 - protein, 390 aa, Homo sapiens
IPSAAVAERGRRECGTGARAEAARDGAGAAAAGGLRGALASRADAPGPGPGIGIAGASRPWPRSGAGRSWSCCSGRGTRAARTAAPRFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 765215 - protein, 137 aa, Homo sapiens
EDPRLSTLCSLHHWILKERLHGEDLGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 765216 - protein, 274 aa, Homo sapiens
MAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKNRSFRSAVT

SEQ ID NO: 765217 - protein, 253 aa, Homo sapiens
MAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKVGAGEHSGPGGTGGWALRPGWRRKVGAWTVREGRHLS

SEQ ID NO: 765218 - protein, 374 aa, Homo sapiens; identical to SEQ ID NO: 765211

SEQ ID NO: 765219 - protein, 407 aa, Homo sapiens
AGTRSATAAETRAAAAEPRGRRECGTGARGIAAMAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGASDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 765220 - protein, 374 aa, Homo sapiens; identical to SEQ ID NO: 765211

SEQ ID NO: 765221 - protein, 190 aa, Homo sapiens
MSSSALTCGSTLEKSGDTWEMKALDSSRLVPWPPRGLGSSTQHPNKPHCALASCQGPGVLPGAASALPELTFQGDVCQSETCQRYLQAAISLDIAVSQINLLGRPSSPPALLIQQGSCEQVIHNSTPQFLGMEDGDNERTTGWLWRLCEDIDAEPSSTGCSRSNQLTFTEGCFVRSLSTVYSNTHIHTHL

SEQ ID NO: 765222 - protein, 98 aa, Homo sapiens
ILALFLVTDFFSTEPAKAIKPIDRKSVHQICSGPVVPSLSTAVKELVENSLDAGATNIDLKLKDYGVDLIEVSGNGCGVEEENFEGLSKLTFSNPIIK

SEQ ID NO: 765223 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQAWNLDTMISLLSEPQELLVNYVSDVRVSPAAPERQEGSSLTLTCEAESSQDLEFQWLREETDQVLERGPVLQLHDLKREAGGGYRCVASVPSIPGLNRTQLVKLAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKTELVVEVKSDKLPEEMGLLQGSSGDKRAPGDQGEKYIDLRH

SEQ ID NO: 765224 - protein, 646 aa, Homo sapiens; identical to SEQ ID NO: 765223

SEQ ID NO: 765225 - protein, 337 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNPPCSLGSHSPLDGSRKTERQRGADKDEVYTVLHGD

SEQ ID NO: 765226 - protein, 360 aa, Homo sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 765227 - protein, 264 aa, Homo sapiens
MPAPVPPAPLELQHPGQGSQPFWQGPTPKACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 765228 - protein, 179 aa, Homo sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWVLFGNSMTGCSAGRVVGPDHCLHPP

SEQ ID NO: 765229 - protein, 141 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVDGKHVVFGKVKEGMNIVEAMERFGSRNGKTSKKITIADCGQLE

SEQ ID NO: 765230 - protein, 444 aa, Homo sapiens
PTKTGPPCSVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 765231 - protein, 475 aa, Homo sapiens
NLRSRYEAGCWLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 765232 - protein, 100 aa, Homo sapiens
FDPGSPGGRRAGCVLPQSRKGAREHGAVCCSCRRVGRRGEPPGLYQGVGVLQQLPEREAAVRAGVRNAALLRRAGCCDRQRRPPPCGEEAAAAPGQGASV

SEQ ID NO: 765233 - protein, 277 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQG

SEQ ID NO: 765234 - protein, 443 aa, Homo sapiens
PTKTGPPCSVKARGNMGLYAAAAGVLAGVESRQGSIKGLVYSSNFQNVKQLYALVCETQRYSAVLDAVIASAGLLRAEKKLRPHLAKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 765235 - protein, 258 aa, Homo sapiens
DYDRTPVFRKGAREHGAVCCSCRRVGRRGEPPGLYQGNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQG

SEQ ID NO: 765236 - protein, 263 aa, Homo sapiens
PTKTGPPCSVKARGNMGLYAAAAGVLAGVESRQGSIKGLVYSSNFQNVKQLYALVCETQRYSAVLDAVIASAGLLRAEKKLRPHLAKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGEIFALTGAKRWIMAAVAGWVLGTGGGPGPLVRLG

SEQ ID NO: 765237 - protein, 124 aa, Homo sapiens
PTKTGPPCSVKARGNMGLYAAAAGVLAGVESRQGSIKGLVYSSNFQNVKQLYALVCETQRYSAVLDAVIASAGLLRAEKKLRPHLAKVRGGEGRGSEPRRSALCHLVSALLPCTAGLEQVAHLK

SEQ ID NO: 765238 - protein, 454 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 765239 - protein, 491 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 765240 - protein, 479 aa, Homo sapiens
MSLPGWGSLVTYVVRCSDTCERVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 765241 - protein, 382 aa, Homo sapiens
EYCTRLGGALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 765242 - protein, 245 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGIHGHAAGPGWRLLL

SEQ ID NO: 765243 - protein, 166 aa, Homo sapiens
FLTPEVRAGAEPGAFCHRAVKARGNMGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPGKLEGVGGWGR

SEQ ID NO: 765244 - protein, 183 aa, Homo sapiens
RTRGSTHASACIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765245 - protein, 224 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVVKDEDCVLL

SEQ ID NO: 765246 - protein, 193 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGLLLIYRKGK

SEQ ID NO: 765247 - protein, 284 aa, Homo sapiens
IRARRAWGESAEKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQGQIFEAYNMAALWKLPCIFICENNRYGMGTSVERAAASTDYYKRGDFIPGLRVDGMDILCVREATRFAAAYCRSGKGPSDGGCDLRSTAVLVTLESYGPEKKSG

SEQ ID NO: 765248 - protein, 419 aa, Homo sapiens
LRLGSEAWVVPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765249 - protein, 271 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQVIMSLNFPKTVLFSKSLIFTVEFLKK

SEQ ID NO: 765250 - protein, 238 aa, Homo sapiens [sequence omitted]

SEQ ID NO: 765251 - protein, 343 aa, Homo sapiens
ITTLSRRGATEAWRLLGHLKETWGHPRRASWVVRSRRCRHCLCFMRKMLAAVSRVLSGASQKPRHGLATLPSLVSISFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765252 - protein, 403 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765253 - protein, 282 aa, Homo sapiens
MVEPQSTYLGCGLVCFVELVCSAHVYVLPFPGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765254 - protein, 249 aa, Homo sapiens
LAADQALPAPSASPQELATTSTMPYQYPAVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765255 - protein, 96 aa, Homo sapiens
WIGFERYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765256 - protein, 74 aa, Homo sapiens
AEVTLEDFWKRLLASVEELKEIDVEVRKEIEDAAQFATADPEPPLEELGYHIYSSDPPFEVRGANQWIKFKSVS

SEQ ID NO: 765257 - protein, 96 aa, Homo sapiens
VDAMKLGVKEMKKAEAGRRLRMLPSLPRPILSHLWKSWATTSTPATHLLKFVVPISGSSLSQSVKGRRRRGYTFRGLPDSVLNLVKEEENPVNEIQ

SEQ ID NO: 765258 - protein, 224 aa, Homo sapiens; identical to SEQ ID NO: 765245

SEQ ID NO: 765259 - protein, 434 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765260 - protein, 109 aa, Homo sapiens
MELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765261 - protein, 284 aa, Homo sapiens
ITTLSRRGATEAWRLLGHLKETWGHPRRASWVVRSRRCRHCLCFMRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQAPGAGDGLPVSFGGHEGWGIIWEGVVTRRIQV

SEQ ID NO: 765262 - protein, 434 aa, Homo sapiens; identical to SEQ ID NO: 765259

SEQ ID NO: 765263 - protein, 472 aa, Homo sapiens
ITTLSRRGATEAWRLLGHLKETWGHPRRASWVVRSRRCRHCLCFMRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765264 - protein, 418 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765265 - protein, 499 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKDMVLEVRQEMGMCQLAGRSETPGHDRATPFIPNHSGVSVAPGANLNHHQGGRREYTPRRHQGSMGREKHVETEWRPSVGLNMTGKLHYVKQHLAERESSFITEYFNTYFDVFSLVSPTS

SEQ ID NO: 765266 - protein, 276 aa, Homo sapiens
MVRKLAVWAWRPASTPQTISSQPTGLTALLSPGAFPSEKFSQSLQFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765267 - protein, 181 aa, Homo sapiens
MAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 765268 - protein, 71 aa, Homo sapiens
LEDLPNTAILPVWNELKEIDVEVRKEIEDAAQFATADPEPPLEELGYHIYSSDPPFEVRGANQWIKFKSVS

SEQ ID NO: 765269 - protein, 84 aa, Homo sapiens
YWGLIYTYIIYVITGLTLGSSNLASVEELKEIDVEVRKEIEDAAQFATADPEPPLEELGYHIYSSDPPFEVRGANQWIKFKSVS

SEQ ID NO: 765270 - protein, 141 aa, Homo sapiens
ITTLSRRGATEAWRLLGHLKETWGHPRRASWVVRSRRCRHCLCFMRKMLAAVSRVLSGASQKPASRVLVASRNFANDATFEIKKCDLHRLEEGPPVTTVLTREDGLKYYRMMQTVRRMELKADQLYKGVVVHACNPSYLGG

SEQ ID NO: 765271 - protein, 108 aa, Homo sapiens
HVGQAGLKLRTSSDPPPLASQSARITGVSHHTQPHVLSFIQSEYRQNKGTHTFGVWTKERFSRDSPPVLNVVIAQKSNIALCIMSIDEICLQHQRGFGPRDQMWPQLP

SEQ ID NO: 765272 - protein, 511 aa, Homo sapiens
VLRCRGWYDKVVYKLHYYHDGQAVRYFHSSANYTVLQARASDSGRYQCSGTMRIPVESAPMFSAKVAVTVQGGRDQGPREGGKCSIEKFWDRSSARKEGAEVQIAATWRVSLRLWTLSPLLCREAALDPPPAWRLVPFPDAHPGFSLWLGTPTERAALAGAGATVGLGRRSDSLASCKAGAASPILGCRTRAECQSGCDMKRLAWSLFLSSFPRPSWTRSPCPTFQKAPLPPPRGHTASSPPPLVCGSARSPRGKQEGAGSGAVDKPAPLLPALSVELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 765273 - protein, 148 aa, Homo sapiens
PRVTGRNAFTGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 765274 - protein, 511 aa, Homo sapiens; identical to SEQ ID NO: 765272

SEQ ID NO: 765275 - protein, 306 aa, Homo sapiens
VLRCRGWYDKVVYKLHYYHDGQAVRYFHSSANYTVLQARASDSGRYQCSGTMRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 765276 - protein, 260 aa, Homo sapiens
TGLERLCDPLRTTELENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVHEDLINKVSDLTKDLCANSICGFVT

SEQ ID NO: 765277 - protein, 257 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 765278 - protein, 257 aa, Homo sapiens; identical to SEQ ID NO: 765277

SEQ ID NO: 765279 - protein, 240 aa, Homo sapiens
TGLERLCDPLRTTELENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 765280 - protein, 194 aa, Homo sapiens
PDCLIRPPQFRAVTELGRPDAEYWNSQKDILEEKRAVPDRICRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 765281 - protein, 189 aa, Homo sapiens
CALDGLPLLRLWGADAEYWNSQKDILEEKRAVPDRICRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 765282 - protein, 227 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 765283 - protein, 205 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGRHSLILPGVRH

SEQ ID NO: 765284 - protein, 230 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTFAVFC

SEQ ID NO: 765285 - protein, 231 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWNAQEEQESSTRICINGS

SEQ ID NO: 765286 - protein, 247 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSLARGGGRPADSPVLTGRGAKLGPSSGRGSHARDEKSRGC

SEQ ID NO: 765287 - protein, 216 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGRSPQLPSMSYSGQNQTVPSTPR

SEQ ID NO: 765288 - protein, 185 aa, Homo sapiens
MVLQVSAAPRTVALTALLMVLLTSVVQGRATPENYVYQGRQECYAFNGTQRFLERYIYNREEFVRFDSDVGEFRAVTELGRPDAEYWNSQKDILEEKRAVPDRVCRHNYELDEAVTLQRRVQPRVNVAHSTDDEPQHEAPSSRQCLTPGRIRLCLPLHGDRTVQAGVLHLADVDISLLGHFQHRV

SEQ ID NO: 765289 - protein, 185 aa, Homo sapiens; identical to SEQ ID NO: 765288

SEQ ID NO: 765290 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 765291 - protein, 222 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHCRYGGQAALGQGLHNDLRRAHLQLCRRLQRHHHHLLVLDDQVAELALPRVVVLYPVVDLHVPPQVGLSGKLVATLGALKLPH

SEQ ID NO: 765292 - protein, 428 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 765293 - protein, 502 aa, Homo sapiens
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 765294 - protein, 111 aa, Homo sapiens
MDTALLLKPPKIFFSAPGIYPRAHPPIRPTPLLQTVLGKLLISPLTKAMFFFPGQGFGPGTSQTHGWSKRLPIGAQAKDSQSRPNFAKKNLMGDDIFGIISHFSRNMPIYK

SEQ ID NO: 765295 - protein, 218 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWEMMKKTMVYRKYCLSKLPNPRRQ

SEQ ID NO: 765296 - protein, 96 aa, Homo sapiens
PVGGASLRTPGWAPPPVRLLFPSAASFFNLVNPSARPLVQRRRLLFLPQLSPFLTSPPDPGDRPPWLYLLRPPGSWEPRMHLVLFLQPGMPVLPPR

SEQ ID NO: 765297 - protein, 466 aa, Homo sapiens [sequence omitted]

SEQ ID NO: 765298 - protein, 399 aa, Homo sapiens [sequence omitted]

SEQ ID NO: 765299 - protein, 399 aa, Homo sapiens [sequence omitted]

SEQ ID NO: 765300 - protein, 399 aa, Homo sapiens [sequence omitted]

SEQ ID NO: 765301 - protein, 399 aa, Homo sapiens [sequence omitted]

SEQ ID NO: 765302 - protein, 466 aa, Homo sapiens [sequence omitted]

SEQ ID NO: 765303 - protein, 466 aa, Homo sapiens [sequence omitted]

SEQ ID NO: 765304 - protein, 466 aa, Homo sapiens [sequence omitted]

SEQ ID NO: 765305 - protein, 399 aa, Homo sapiens [sequence omitted]

SEQ ID NO: 765306 - protein, 466 aa, Homo sapiens [sequence omitted]

SEQ ID NO: 765307 - protein, 420 aa, Homo sapiens
PRWRPRVNRPRRWSGHITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765308 - protein, 550 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVKQKDIISSSHSPSSLPFSNLRHLMLIRHLYEMRSEGKESAEFCCINGLGDLSWVFFTQMLLSFFIFLLPCPCWCSEHCLFFQQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765309 - protein, 278 aa, Homo sapiens
PRADSARGLIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765310 - protein, 466 aa, Homo sapiens [sequence omitted]

SEQ ID NO: 765311 - protein, 466 aa, Homo sapiens [sequence omitted]

SEQ ID NO: 765312 - protein, 466 aa, Homo sapiens [sequence omitted]

SEQ ID NO: 765313 - protein, 466 aa, Homo sapiens [sequence omitted]

SEQ ID NO: 765314 - protein, 368 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRWSRNGMATTEDVRKNRRESCRTWYDPVR

SEQ ID NO: 765315 - protein, 263 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHR

SEQ ID NO: 765316 - protein, 103 aa, Homo sapiens
MGGYSWKTTAPVPDNQGVLAPLFEQGIDSRLDMVSSDYQVLGLRALKIVSLPPRPLPQEIASLFINIFFLPFPESSQYNVSEAPFAQVFSNSECSTSFSLRKD

SEQ ID NO: 765317 - protein, 165 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTLLRAKKNLVPNS

SEQ ID NO: 765318 - protein, 163 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVKQKDIISSSHSPSSLPFSNLRHLMLIRHL

SEQ ID NO: 765319 - protein, 68 aa, Homo sapiens
ARTSWVVSTLSTRRRGLWCSGGGSCSCRSSLPFLPPHQIPEIARHGFTYCGRPALGNQGADLLSEMTA

SEQ ID NO: 765320 - protein, 68 aa, Homo sapiens; identical to SEQ ID NO: 765319

SEQ ID NO: 765321 - protein, 472 aa, Homo sapiens
MDELGCFNLVNPSARPLVQRRRLLFLPQLSPFLTSPPNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765322 - protein, 423 aa, Homo sapiens
RLQYPRLGTRLGGETVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765323 - protein, 400 aa, Homo sapiens
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765324 - protein, 444 aa, Homo sapiens
MALLTAAARLLGTKNASCLVLAARHASASSTNLKDILADLIPKEQARIKTFRQQHGKTVVGQITVDMGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG
